United States Patent 7,109,033 (STRESS-REGULATED GENES OF PLANTS, TRANSGENIC PLANTS CONTAINING SAME, AND METHODS OF USE) - sequence listing, part 3

SEQ ID NO: 4083 - DNA, 2000 bp, Arabidopsis thaliana
cttaaactcaataattgttaaccattgtagtagctgaaatttgggatgcatactaaacaaaaattattgtagttggggaagaaataattaatgatcatgtttcatgttatttgagttaataatggaccatatgataactgagtcattaaatgcttttgttctttgaaatgaccaactagaatcaatgcgaaagacacatatatagcgcatttgatgtcatatatactattattaaattcatatatacatctaacgatacaatttaatttatctatgttatgtactgttatttttcatgattctcagctgataagacattatacatatccaaatcgaatgcttttgaataagtgcacagaagttaatagaaagtaagcatcaaattctatattaacatttccacactattttaatattcattgcatttgcatacatatatatatatatatatgtatatgattctaaaagttttgaaaatagcataacaagaaattaataagtggtaaaaatattaaatgtcatcaaccgttaaatattaactattcaagtaagaaatcgtattaaaatactactatgttacaaatcttcgtttttttttgtccgaaacaaaacagagcttgtgttccccatgcaattaatcttgggatctaaaaaacaagtgaaaaaggcagacttgttaagtttcctatgagatttatattgtcagaggattagattttttgtgcatgagtacatactcataaaattaaagaagaaaaaaagcagaagagtaggtcttaacgctccatctgtttcccatggaagctatctgtcctttcttctccttccgaccgaacacgtcctctccatctttttcttttttccttccatatattaaaacagtttagatgtgacgaaactttataatatgtgttaaagttcgagatttacgatctcatgtcaaatatgaaaaataaagatagagagtaagtacgtaccctgttatataactcttataaaatttagtactgttacgaatgttacgagtctgtgaccacttgaaaacatgacaacaacatcaagttcgactataagatataaacaagtttttaatttggttgttgttggattcaacgtccactgaatatataattattttagatgacattttgtgttttcaattatatttatattaacgatttgtacttagacaaaatgatacatgcatgagggaatctattatattactactattacttagacatatatatatttctatatgcaaaacagaggatactcaaatttcctcatttgtcaaaaatgctggcagatgttatccactacaaataattacacattaggtcattgtaacttactgattttgtcatgtttgtctgttatataaatcgactaactgtatatatagatttgatctaaaccgaataatcgaaccaaaacagaatcaaaatcaatcaaggaagcaagcaaacaaaaaaaccaaaacatttcacacataaaagtccgaaattgggttctttctgattttgatttgaaatttcaaagaaaaaacaaccaaacacacttttacttatcctaaaacaaaacattttgctcgtgaaagtgatgttaacacttgctataaatattcatctagaatttgcatggtgagatatgatactaattgaggcaagaatgtgcgtttgatataattttttctttagtaacaaattaacaatataaatatcaccgggattttcatatagttttattatacaaacctattgtgattataggcttcatagctaaagaaaaagaaaaaaatatgaaatatagaaaacaactaaaataaaaagacaagaatagtaacaactcaagttcatgaatccaaccattgatccgaccactatataaacccctatccccccccccccccataactcctactcatcaccaatacgggcaagttaaacccataactcccaaaatccatatcctctttaaaacatttttgtccaaataaa

SEQ ID NO: 4084 - DNA, 2000 bp, Arabidopsis thaliana
attactttatttgtttcattttctccatgaaggagataaaaagagtaaaaattagagattgatgaaaactgaaaaagaaactgaagtcggtaagataggtgttggaacttggaataatggcttggctttgaacaaaacgcatgcaccattcattgccttcaagttttttgcaattagctttgtttttgtttttgtttttgtttttgggagaggttctaatgaccaagaatcaagagcgttgtctaaaatctaaaccatatgatacggtttttaatattctcatgcattaaaatgtactatttctatatatgatcttatatacccaacatcttggaattaatagtttgattcgttatcatttgaagaagctctcaacagcttcaaaaagcgaaatgtagcatcatgaagcggtatccaatttcaagaagctaccagtagcttgtggaagttttcaagaagttttccggaagatccaacgattgtggaagcccctcatagtttttggaagttttcaatgatattagcagcgttgagcgtggcatggctagacaatgtaagagatttgatttgcaacacatttgatgtatttttttacttttgagttacaattgtaatgtattattgattttgcccagttatgatttataaaccctacaatttagtatcaaagtttttatttaaaattctgaatctgacattaatgatatctggctcatttacagagccaatgagatggatgatgttcgaaactggattggccattatttatcttttttttatctggagaatctcgaggttggcacaaacattatcatattagcctttagaaattggattggctaatcacacatttatatatattcttaccaaaataaatcacctctcccgtaattgaaaaatatctaaatactgtaagtctgaaaaaattcacaagggttcgaagaaagaaggaaatatctaagcatcattaataaactatctgtaacctgagggaaaatcatttcatgttgaaatatgtggatttggaagttttataatctatctgaatttgtgaaatttgataacaagtaagatttgtttcttaacacaaatctaaaatttgttttctaattaggtttgagagagagagagaaagaaacgctttgtatgatacacatctaggctatgaatgaaggcagcggacaaagcggtctaatttgtctgcggtttagtccatctcatttttggggtggacaataaaccgctgcggaccaagtttatttgtatgtaaaaacggtccgcagatggtccgcaacgattttcttctatttttttaagtccagaccactgcggactataattgatgaatgataaataaaaaacggtctgatccgttgacggttttgtccgccccaaccgccataaccattcaaacccctaattatttcatcagataacattatacactaataatcattgcactcaaatatgtcacacaatcatataataaaataataacaatgattaaaatgaaaaaattgttgtggcgccgcataaaatagaaatcgtgagagacgacgtcatctaaaaattgccttgctgtccacttttcactttgtcctctcttctcatctccgttcacttccacggcgtttcctcagccgccgattttatttatttcccaaaatacccatcacctatagcgccacaatcctctacatcacaccctaatctcattaccatacaccacccaacgaacacgcgccacttcatttgttagtatctaaaataccaaacctacccttagttccacacgtggcgtttcctggtttgataacagagcctgagtctctggtgtcgctggtgtttataaaccccttcatatcttccttggtgatctccacctttccctcacctgatatttattttcttaccttaaatacgacggtgcttcactgagtccgactcagttaactcgttcctctctctgtgtgtggttttggtagacgacgacgacgata

SEQ ID NO: 4085 - DNA, 2000 bp, Arabidopsis thaliana
taaaacttttggccaattactattaaattttgaaactgaaatgtttagaatatctatgaattgaacccaaaaaataattaagtcaactaaaattgaatccgacaaatgctgttttttgttttgtttggaattattacttattaaggaaataaaaatgatagaatttgtctgagttgatcattagaattcgaatcgaaaaagaccttgccaaaaagagaaagcgaaaatggtttaagaaaacgaaagacttccacttttgtcctttttttttaacatctacttttgtcatagcaaattatctgtaaataagatagggtttatgcttattgctacaatgagcctaatcctatgatgtgtattgcaatttgcaaccatgcgagtttaattatttgtttactgctatagtgatcattttatgatgtgtttttattaattacaaaacagagcatcaaaaatcaaaagaacatatcgcataatcgaactatgctaatacctctcctcaatctttgttgttgttatattcaagtagcttattcttttgttttattttacgattagatttctctagaatttaatttatattatttaatcatacttgatcaaggtttgtagcttaatcaatatcgttatcgtgtcatcctgcagattcaaatgatcaaatctgataatctacttatatgtattatatatattagataccaacaacgaacaaaatcatatttctataacatttgtttggttaaatatatttaaagatttgtaacagttgttcgggttcaaaactatcactttgtagttgtaggatgaggaaaagtcgtgatatgatcatctactaaaatcatgtgttttttaaagaacatgattttcattggatagtttaataaatgttaaaaaaatactaagtgtcaaagaagagatttgaaccatatgtagaatacttgattcgaattttcctgacgaataatctaatatccttttctcaaaagaaaaaaatgtttgttaacttggacacgatattattatccaacttcctttctagatattcatttttaaattacctatatatttttattttctcaaaatatactaaaaattggatagagctattaaataaaaaagatagaatttagagagaaatagcaacataatgaattataatataaatattttgtaaagaaataacaaactttatagttagtttgcctaatatagaaaaaagattacagttatttacccatttgtttgtgtgtaaaaaaaggagtaaaataaacagagaaaagagcttcttgtttttacttgtgaacgttattgacttttcggcctctctctcttctctatacaaatatatggatcttcatttcttcgtatagtgtaagcagtgacgcatccatttatcatcatctccttataaatctcgaatctgccacagagagagcgtgtgacaaaatgagttcataagattccgttatcgtcttcctgattcctccaaatctccggcgaatttgcactctttacctctctttgactccgtgaggttttgttttctccttatcaatcgaattccatttcgtgctcgttacgtgatttttgtagattttttttatggggatggaaacttgtttattatctatagatgatgattttgttttctccatgagaatctatgcttttaaacttttttttttttgttttttgccttcggagctaacttttggtgcttgtctctgtctctgttttctctccactaaaaagataaaaagctttttgccatctttttttttttctcaataatctatcacatcgttttttttctttgtttttttctccatttgtcttcattgagttcatagccacataattattgatttctttttcttttagtgtttctgttactgatgcgtttcattatttatacttctcacttgcagattcgaggattgttagtttcttgtgatgtgtagtctttgaagcaggggatttttattgtattgaggaagaag

SEQ ID NO: 4086 - DNA, 1458 bp, Arabidopsis thaliana
ggcttactggaacagtgtttgatctgcaaaccaaaacaaaagcaaaaagaggtcatttgtctatatactcattcacaaaggaaaaggtgagcaagagatagcttagtaaaagaaaactaataagctccttccaactaaatggagactaggaattaataaaactactgaaaaactaaactctaatcaacagttagagaatcagaaaagaaagtaaaacttcaaaaaagaagcttgtcactaatagtttctcagaggaatttcgtcgaacaccttacatgcatcagttccagccaaaattttctaatttccagttccagaggcctactctactaacccaacaaaatcgtggaagagaaactatcgataagaaatttgaaatttgatcaaactaccgaaagctccatcaataagcatagacattacaaaatacaaaccctaagatttcagagcaacgaaatcagtacacaaaataaacaaaccccagaaaaaggtgaaataaaactcacacaagtaaagggagatctaacttgagccaatagagaagaacgttgcgacgagaaatttccagagcgccaagatcgacgacgaagcaaaaagagcaataaaacgaatcgggtcggattctacacaaataacgaagcatccagattccagtttagtaaagtgggtccaatcagaatctttaaagcccaaagtaaaagcccattattattggaccagattagtttaagttgctccaaaccaaaccggcagtcaaatcaattaaaccatgtcctaatcaatagtacccaatttagacccggtccaaacgttaccgtttatgagtgtgcgcaactagcagctgccactgtcagtgccaaattggtaatttcattgacctagctttgactgagtatcaccacagtgacgtggctttttcacaattataaaaaaaatgatcatattctagacatggaggtaaagtaaagcaaagaatctgcatttttgtattttctctaaggaacaattacaaaatcttgataccttgtgagatcataaagaaggtcgttaactcgttatctattatatttatataccttgaattcttgatacgtttgttttacctttttttctattgataatacgtttgaagtttgttttactgttacacattgattttatatgtgtttcccaaaaccgtttaagtttcagagtccggagcagtaactcgtaattcactaatactggtattaaatgttgttatttatgggtaaagcataaatacttaaattcaattattataagaaaataaattaaaacccgaccccatatttttcgtccttttaaaagatggagtcctcgaaaacattacgtattagtaagttccatgcaaaggacaaacatataataacaacaacttctcttctttactcgtttctctctctctcttttcttttcttttcttcaagcgcttcttta

SEQ ID NO: 4087 - DNA, 1925 bp, Arabidopsis thaliana
ttataactacagcaacaaagaaagcagaaactgaagctagcagcaaagatggtaatgaagcaatgacaacatcaaccatcaagatagagggttgattcagaactactacaatagccagaagaagggacaaacttcattgtacactaactcatcatcaaatctctccaacaacgttctagaaacattcattcatccatcgtttttaggattctagaatcttaattagtacttaggaggaggaagaagaagaagaaaccatcatcacattctttctttttttttgttgttgtttcaaattgcattttaggtaaaagaatcaagagaaagcattggtggctttcttttagattcttaagaaaacttggattggtgcagaaagcatcatcagattattacattcatttggggaattttatttttcaggttcaaaagaaatgttttatgtcttcttttgaacctaaacaggatttttaagcttcggataagcttaaaatcatttcttttacatttgtaattcttgaaattgttataattcaatcacattgcttcttcttactatatttgttcgtttattatgattataaaatgtttgatcaaccaagaatccgttcatcgatcactttcacctggagttttctcgtgttttataatcataaaaagattgaacctttttgataattattttgaattcgtatgatcattttctgagagtaaaatgattattgtctttggattccaaaggggatcttatgaagacaaaagtaccggtcaaaagaccgttggaatcaaacggatctttttcttcgtcaatggataatatttcacttctactattcttttaacaattttataataaaaaccaaacaaacaaaacatagagaatacataagttatgggcttttgaaaatctaaggcttaaattcttataaagcccattaatttttatatgtgtaagtaagttggccatagaaagcttaaagccttagatatgtaaacacgcaagaatatggtaagttgtttattacgcactgtccacatcatagatcgatagatattctttccacgcaaagcaaagttttattaagatggttctagaattccttcttatccacagaaaatttttatattcaagaaaatccaatttttcatttggagtcgaaatttacgcggccactaacgaaatttgatttaattaaaactagtgggcatttaatatttgaaaataatactatttgttaaatcccaattgaaaatttaataacatttaatataattaacttttttgaaaaaaggaacaaaaaaagccatccaatttgaatgatacatagagcagctgaaaaaaaaaaatctaccttttagaatttattaaatccaaccaaaaatcaaacttagccacacaattacaatagaaacccacgtgtcatccacatgaccactagatattcagacgaatatctccacttccgtagagcgattaggttaatgacacgtgttaaggtggacctgcgaagcagaggaccacctccaccgaatcagccgcgatacagagaaaatcaaaacaatggctcatattaagccacgtcagctcagtgaaggcccgctttgttacacaccgttaattagatttctcaaattgtttatttgctctgagcttatacaacaaagtcttcttctttctctgagaagatattttcgtggttgtgatcgaaagataccaaactaaagagtttaactttcttcttccttcttctttacttcaacatctgatattttctctctctcttttattcagtctgaaacaatatttctcggtagattaagatctaaagctcgttgatctagattcttgtttctatttttgtgtgttttaggctttgttggttttaccaagtgttgtgattcagtttgttttgaggtctgagtct

SEQ ID NO: 4088 - DNA, 2000 bp, Arabidopsis thaliana
taggattttattaatttttatttgtctttaaacaataaagcttaaagcaaaagtgaaaccaattacaaatttacaacagttgcgatgtgtctagaaaagcgaaaaccgattttaaccctataaggccagaccaggccaaggcctatcatatcaaaaagggcaaaaacgagtgaatttggacaaaatcgaaaccaccaatcagaaaatatatgtggttaaaactttgaacacatcaataaacacgaaaagggtaataacgtcatttccataaattcgtaatcattcgtcctcaaatctttattgtcacttttacaaaaaatactcccaatttcagagaaacctgttgaaaaaaaattcagggaaaattggaaaaagtgatgatgatgacgagagatcaattcaaatcttaagtcctccaaattttaaaaatttcgatctccactaccttcgtcatcttcctctacttctgattctcttttctgggtttgtcgtttaatgggttgattttgtatcgtcaaaacggagaaaacaagaagacttcttttggttttcttattgcgaagaagatatttctagggtttcgagattttctgggttttctgggtttttgtgtgttctttgattggatttgattattgggcaatttccttggaattcaagaaacttctaaggttcttaaagtgtaaagctttgtgattttctcttattcatacattctaggactttggttttggagttgtaatggcttttgggtctgaaaatgagagcgagacgaagatggaaggttggttgtatataatacgatctaatcgatttggattgcatttctctagaaaacgttactttgtccttggagatcatcttctcaagagtttcaagtctatctccgattctaaaaccaaggtcaccaccatttgattaatcgcaagttcgtttggttgttcataatctcccattttggattaggattttaacttttagtagaatctgaatttggtttttacagaatgctggacgaagtgcggtgatagattcgtgtatccgtgttactgacaatgggagagaaaatgttcatagaaaagtatgaaagttctcatttttaaatctttagttgtggagtttagttatgcttttgttttaatggtttgtctggaatacttgtaggcattcttcatatttacactatacaatacatcaaatcacaatgatcagctcaaggtaaggtaatttctgttgttttgtttttatgttggtacactatatacatctctttttttcatttgttaagctttcttgttttaattgttatatagttaggagcaagcagtcctgaggatgcagcaaggtggattaatttgattaaagaggcggctttaaaggttatataaatggcaattagtaacaagttaagagctcttcttggaggttggagacttatagttatatgttttatgcagggtgccccttttcctggagatgtttttaattgttccaggagtcgatgggactctttgaggtacctctttttttccacgtaatcaattggatacatctctaagctaactgttaaataaattgctgagccagtagttcctgccaatttttgttagttacgtagtacagataatggtttgtggttacttaagaaagaaaatttctgaaatcagattgagtagctcagtgcgggaccatcactcaaactctattgactggacacttcggtcgtctgcacgagttgatcctgttacaactgatgttgttgcgccttctccctggacaatattcggttgtcagaatggtatagttcatactcaaatttcattgatttttgtttggctggaatgcatagtgttaacatgtgttgcacgcaggtcttcggctttttaaagaggcaaaagagagagattctctcggaagggtcggtatttttttcactcttaatctgttgaaaaggtattttgggtttattgaagggaatcatgttttgatgattttgttgc

SEQ ID NO: 4089 - DNA, 1681 bp, Arabidopsis thaliana
gattcaaatctctctctctctgtctctccttctctctctgtctctctgtgtctctctcacaatctttcataagaggtgaagaaggctaactaaaccatgagcagtaagaaaacttgtgtttcagtcaaacatcttccgtctgtttctgatctaaaaaacaaaaaaaaagctagaaaagctttgttagggttttaactttattaactctcgtgtttaatataattttacagatttaataatgtatctaaatatgatttctctggtctcaacatgagaggttccaacatgagagtttacaacccttggccgatcttatgttgttttaagtttattctgacacctctttttttaatacaatcttctgtctgctctgattgacagcattgataccatgatcatataaccgttgcatgtttctgaaatcaatctcaaaataattgcttcatagtaaaaaatgattacaagattcgagtttcatttattatcgttataacactcactgtctcattcgtcaaagtctttaacaaagtcaacgaacgaccattagcttgggctttctctccaccgacgcgccgctctcagaatttccacttactcattgtctttatattcaaaaactcaaaaaaaaaaaagtattaagaatggcttaagaccgaaacgtgttttctcctagtctggcaaaacacaaaataataaatataaggaaacgcttatgaatacttttcaatattctacataaagtcattgaaagaaggattggaacaaagtgagaagcaacaaaaagaaatcaaaatcgtagctcctaagcaatacgtttcttcattggcaacggttttgattccatttcgactcgaatgaaaaaaggccaaagagtattcaggcaattacggtgacggtggcaacaaattatagattaaaacgagccaaaatagaagaaagtgccaacaaatccgtgtgggcaccaatccaaagtggcaaaatcaatcaaccagctgtcctctccctctaacttccgatcaaagactctctttttttttgtttacgttttcttttcctcattctccttgtcttattttgattgcattatattgaacttgagtttaatcatttttcattattaaggttatttatttatagacgcatgatgcatcaagtcataataatttcacccgtgatgatcacataataatactaatccaagactccatgtgtcgtaccccaaaaatttatctcaattatactatgtaccttatattgtgctatttttttaactaataatttcccgacaatttagtagttggaaatttctcgaccgtgtgatataatctataatataaaatatcataattattaaacaatgataaaatttgtgagcgacattggtatcaatttcaaatccaattattatgttgacacaagactagtgatttatagtataaccaatttaatgtctaacgtaaaaacaattactattaattgattttctatatctgatcatatgttcaacaaaacacatgctaatctacccaccattggcgaataaatttattgcagaatataacaggagaaaaatgccaagaaaaaaaaatccttataaaaacgcacaagaaaaaagtaaaagagctattctgtaaaataaaaatgaaaaaagtattgaatcctacattaatagatacaggat

SEQ ID NO: 4090 - DNA, 2000 bp, Arabidopsis thaliana
ataaagtcgaatttgtagttgaaaataaatacttgtaatcaagtggtttgtactactagtagtctagtacccacgtcgtatcataacttcattcaaatttgcaagtgtatgtgttggagactttgaattatatactaaaaataaataggcaaaaaataaactgaatttccaaaaattctttaaatgatttcgtacgtgtattattgcttgtgatctttgtttttgtttagatgattttagtgagacgagaaaaaaagagaagaagataaaaatgcatgacatcacatgtcagtggatccagagtattatttgatgacaatctagtcagattaggcattcggtgtttaatcaagtacttgtatatgatagctagctaatcattaagcaaaaaaatgagatccaatgactaattaatatatttgattagcgtgtttaatgaagatgacatataattataatacggtgttgggtgagatatactttgttactcgctttgtacatacaacaagtgtttgcattattttattcctcttgaatatattgaatattacggatgagtctgattgtttctcaatagttttggaatggcaataattttatcaggaaacaaaaaaaacgaaaaacaaggtgataacaaaaagaacaataggaatatgaatgaaaaaaacaaaaaagaacaagaaaaacagaaaatgataataagtaggaaccaagagaaacatagaaatagaacaaaatgattatggtaaatggtaacaaaaaaggtgaattaatatttaatataataattactaaataatcatttatttgaattttgtttattattttcatttaaaattaaagttctgtataaatttaaaataatttatattataaatttttcttcaaaacatttatttattttatagtaaaattttcaattatattacaaagttaaaataagtttcactttaaaacatttatttatactaatttaaaataaattcataacattcattaaattgaaagtttgataaatttttttatatatatcaatatatactaaagatatgtaaaatattatatttaaatataaatattatcataaaagctattttaaatttatttaataaataaaaacgaattttatttttttgttcctcttggttcctctacaattttgttctatcatttttttttttttgaggaatgatgaggaaaaatgtaagacccatatgtataaaaatggaacaaaaataccttgcaaatggtaaaaaaaactgaggaacaaagaggaatacaaactttcctactcattcttttcctaaaaaatggttatgaataggagccaataatttagtaatttacacaaatcgaatatttctatgcgtgagaggtgagacctaacaattcaattcaaatttgacattatttgggcctccttcttaagattcgcctacgtttgatcaatctaatttcatattgggctattaagagttattaaaggctcatatgaggcctgtaatgtttttttcgccgcattatcggaaaaacctcaagaagaagagtggtgacataacaaaaccccaaaagctcccaagcctagagattctgttgttgatccgattcccgctctccttctccggtagtacaatctccgtcgccggttacatcagccaggtaagagacattagtttttattttgtttcgaagtttcatctcttttctttccactttatccccttcaaggaatttgtgctagatctacgcttttaggtcgctggcatttgattgattttggaccaacaaaagctaatttaaatgttcatgaggtcttgagatttgatgattaggcttttattttgtcgagactgatgttaggtcgaactatgttgatttaggtttgggattcgatttgattttatggaattggattccttagatagatcctttatatgcatccgttaggtcctcttttaatttgtaattctaaactgtgtcttagggaagagttttaagag

SEQ ID NO: 4091 - DNA, 2000 bp, Arabidopsis thaliana
attttagagaagagatgcgataaaaagacaaccgtagaaaaataaacgaaaatatttcaacaaaagaattagatgaaaagacacaactgaaaaattaaccgtaaatattttaacaaaatgttgcattgacacaaccgttcataaatgcaaaaaggattgggataaaaagacaaagctttttatatttcaatgaaaagatgtaataaaaaagacaaaacaaaaaaaaacgtaaatattttagtaagaaattgcgataaaaagacacatccgttcgtaagtaaaaagacattacgataaaaagacacaaccgtaataaaaaaacaataaatatattaacaaaaaattgcaacaaaaaaacacaaccgtttagaaatgcaaatgacattacgataaaaagatgcaagtttcggggagaattcgcaaaacttcatgaaaatacgcgataaaaagatataacaaaaaagatcgtaaatatttcaacgaaaatttttcgttaaaaagatacaaccatttagaagtgcttacgaaagaaacgacacaaccgtaaatattgcaacaaaaagttgcgagattaaaagaaacaaccttataatctctttgatcatatgaatggaaaactaaatctttgcacacaaaaaaattcaggattttcatattattttcatgggatttttgtttaaatgggcacatttcagccaaaaaaataatgagagggtacattcttgtgggcttataagaatgagtacttatttggctaagaaaagacaatcttgtcaatactctttcttctttctttttttttttttttttttcttttttttccaaatgcttcatagatctttttctcccttattaattcaatagatccaattaaataggtttgtatataaataaatctatatcctaagggaataatgcttagggaacccaaagatttcaagacgcagattaaattaattttacatttgatcgataaatatattggtcggtggattttgattcggactgaaacttgtcaccagtttaggagtcgaggaaagagatgaaggcagtgtcactggtttttgattagcaaagactgaagatggaaggcgttaacggcggaaatgaggatcgacggtaggatatgttttcgatttgatagaacgatgtctaataatcgctaagtaattcaaaaacagatgttcgatggtgtatgtgtcatgttgtgatcagtttacgaattacgattagggtgaattgagagacaaatcggaactggagattgagggtgaattgtagagacaaattagacggttaaatgcgaataataaaaaagataaaaacgtcaatactgtgagaaaaatacctaattgcagtagcacatgattttgtgcctatttctacaacggcatacacttttgaagtgctttatttgtaactgatccttattttcatgcatgtgagtgatatcaagttgtactttgttgttttgaaatgcctagaaatgacaaaagcgtgtgggaatggacataatcgtttttacaaaattgtgggaatggacatgatccttatttatggtttgtacgcgacggataaatttttatttaattacgtaatcgtctggatttatatatctttaatgcagattgaaatatggcagtaccaaattttttgcatagtcttaacttcaaatcgatcgtagttattacaaaatgtcacataattcgtaatgtgtaattaaaaggtactccctacacaagagatggtgactaatgatcgagtcggccagaaaataccaaaaaagtcctcaaaagtctgatgtgatctcccatgcttcaaccgaatttttggaataaagaatagattggaaaaatatctgccacattgtagtattttcaagtaagctttctttgtttgttcaataatcaaaagcaaaaacaaaaacaaaactctcaacactttttgtgtttattttctgttattttgaatcgaagtcggcaagcataggctaaaaggtg

SEQ ID NO: 4092 - DNA, 2000 bp, Arabidopsis thaliana
caccaatatctagtattggaatcgctgtggtgtttgtttgtagatatttttctacatttagcaatgtattacattatgattgcaagaggaagcaatattaaggtattaataaggtttttacttttaccgggttagaattttgggtttgtttattggatgaagaaattatccacttgtcgatctttcataaaaagcacacgtgaattagtttcgacatagttatatagttctcctaatatacgttatttgaacaagaatacttgactagttgatgtaacgatgttttcttaacgtttcaaaagtaacgtacgattcttccataaccaaatgtcttgtatataatggtagaatatatattttgttttgtcgcctaatgattatgatgtgcgttactttaatttagaaagcggactatttaaaaactgctatattgaaaccgcaagagaaagcaatagtaaggtattaatatggttttacttcagccagatttaaaccaccaacaatactttaaaccattggtcgatctttcaccacaaaaaccacacgtgaattagattcggtgtggctagttccctaaacatacgttactagaacaagcgcacttgactagttggcgtgacgatgtctttcttactaatttaaaagtaacgtatgattcgtccattaccaattgtcatatacctaatataaaatataaattcgtttgtcgcttaataatgataacatgcgttactttatgttaaaaagccaattttcgatagattttctattaattgtaacgttataattcattatacataacaaaaaaaatcttcaacaataatatattgaaatttcataactaatggatgctaaaatgttagattaatagatagagaaaacttataatactcaaaacatttaacaccaaaatttccaatatctagtaatggaaatgtaatgtttgttagtatataaatttctgcatttagcaacacttatgcttaaaaacacatcattgatccgtagaataaaaagacacctcaagtgtactaagtaaccgttagaaactgcgtaaaaaagtttggtaccactttttcttttactttttttgttttgtcaagttacttatcaaaaacttggaaattaactttctctctttttttttaaactcgtgaataacaatgaaacattcgtatatttttatatcataaaagaaaacaatacggtattatatgaacaaaaaaaacttaaagataaaagaggtcaacaaaatgtccgaagtatgatgatgctaagtttgattagttatcttttttatgtcagagaacaattaaatttgttttattattatactaaaagaagaaaaacctaaactgcaaaaataataattacgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcagagctgttcttcaagatgggattgtgtaagcttgaaacttgactatctgggtctctcccattttctgttctcttttgtattctgagtgaaagttttgttttctgggggaaaaaattagggttcttag

SEQ ID NO: 4093 - DNA, 302 bp, Arabidopsis thaliana
caaggtatcaaaacctttcttcctaactatccatttgtctaattaaaaaggttaaaagctaatttaattaaagagttagtactgttttgaatttccccaagtgggaagtctttatttatggcttcacgatttcaaaatccagaaagacaagtagaaaagaaacgtccacgtcggataataaaattaaaattccaactttatttctcgttcacatttgacacttcatcacacgtataaatatcgtcgtgtgtccttagaaatttacacacgaaaagttagttaagcagcaacaaaaaaaaaac

SEQ ID NO: 4094 - DNA, 1716 bp, Arabidopsis thaliana
atacacacaccagttcttgcagaagcttgagtctttctgctttttgcgtaacctgctctacaaagccggtttggatttgttcggttcaattaggtgccactgtgctaggtgttttgaaatatttggcttgaatctcgagcctttactctatttttgttctgttccagtatcagcaaccatgatttggtccaaaagactgaaaaactgtgcgacttacatctatgaataaggggctaagctagttgtactttaccaaaaatagcttaccagtataagcaacgtttggatacttcttgatagcgcatcgttagctttgcccgtgcttatgacaaaagatcactaaccactgaaacatattttttacaaatgaaaacagaaattgaacttgattagcctgtgtaaccatgtttcagaagaaagcttactcgttttttcatccgacgaaactcgtttggtattggcgattcctggaagggaagcatgaagatttatccattgagatggacaacctcatcatctatctcctctgtcttgtttctgatctctttcaaaacttgtttgtcttttctctatcatcaccacttaagaaaaggtggctgtttttgagttaacggaagtagactcactcaagtgaggctatagctaaggaaggacatgagttatttattggccaccatgcggataaggagaactcttgaagtaaggttactcatatattttcacttgccccgatatttcatggaaactacaacattttccacgaactattgtttattacatatgttttctaagactttatttattacagatatcgcctgaaatttcgtattattacaaaaacacacgtaaattttgtcaattccaaatatctccaaatttttgtttgttacatattgttccctcaagtttttgtttattacagattcccctgaacctctcatggtttgatgtaaacctaaaacctcaaaatcaaacaagtttgtcacagaaagatatatagtctccaatgatttcgtcagtgattcaaggtctctcttctttctctaaatacgtaacaactaacacggaaggcatttcattggctacaattatttcaaaatttatcttacaaaaaaggataatagagtgtgatattgttcatcagagacgtccacgtaagggtaaactaatcagtatatggacaaaaaggtacttgtttatctacaccaggaagaaaaacaataccagttttccggtccacaacttttgcatcaccatgcatccgcagccacgtgtgttcttatgaatattaaaatctacttatttcgttatacgacaaacgaaagatactgctttgttgcgtagacaaacaaacaaaatctcttgataataccagatattcttaattaattagtacgttttaaactcaacatacccataagaaaatccagttagctcatggtttcatgttttccaatagatatatgtgtatataattaaacgctttgcatcgtttgtgatttgcatgttggaaataataatgttttttttttgctaatcaaggtttgattaaggaaaaggagtttggactttggacctttctactacaaatacatgtggccctttttggccaacaccaaaagttccaaaaaagaggccaaaaaataagcaacaacttttgattctctcgtaacttcccccacaaaatcagcagagcgagagcgagagcgatcggtt

SEQ ID NO: 4095 - DNA, 2000 bp, Arabidopsis thaliana
ttatgctatgcacacaaaaaaagaaacacaaaatgccaaaaaccttatccgacgccgtttttggtgggaaaactttgcgaaatgttcatgattaatgggtacgaatggtgttacggggttgactaacatataccctaaaggattgttgtaaatagtgctgatgcatgtgatcctcttcgctgtaatttagcaaaattattttgccacgtaatttagcaaaattattttgccaaaagaaagaaatggacgggtaagtaaaaaagagaacagaaaaagtaacatggatatgatgataccgtgatgtctttaaatccgcctctaattgaggccgattgattagtgtctttgggtcatataaacgtagacaataagttctcgttgtattggttttggaccagttgattcaataggttttatgggatatttgaggaacattaattgttgttctacattatcattgtctaatgtctatagtctctatgaatttgtttctaatagctaaaaagaaacctaagagatcaaaacgaatcaaaactattgtataataggttatactgatggttttgatcaaactattgtataataggttatactgatggttttgatcaaacaataatatcaacatagaaagtgattaaagcaatggatataattattagaactaaatattgacgattctaacaagtcaatttactttcactcatatgcatgttcatgtttttttaaagaaatatatctaatcgtaaataaaaaatcatgctaaaaaattggaaaaaaccaagatggtagaggtagtagtgtgatcgaaataaacattcatgtattttttggaccaaccacaatcagataacaacttactctatatatatcaatataatacagaatggataatttgttcatttatcggtgatatgcatgaaccatcatcatatattcgttgccactagcgttcctagaacacgacatcatattaaacatgcatgatataggtccagatgttaattccgtatgcaccatataatgtaagaaacttttgatacgtttcaacatattgattctgtgtgatggcaagaagacgtgaaactcctacttttgctatgtttgtagctttttgggtgaaattgacttgtaagatcatcatgcagtgcgaaacaaccatatcattttattttgtttatatttcaataatcaaccgcaaaaggcatgaacatgatgcgcttagttcattacttcataattatcaatggtttgtaagaatagaaaatgttgtatatatatgatgctgtagacagaagaaataacgagggtaattttgattcgaattacagtacaaacaaagcaatgttgtaacaaaggtggacgtaattatgcagcacacatgatgtcgtaagtgtaatcatgttttgtatatattgatgttaatttaaaaacttttaaaaggtttgtataagtttctatcagccaatacaattatattagaaaaaatatatttcggtcattcagaatcctatatgttgaataaccaattagtcaaaatttgatagtatcagtttttttttacgttttatatatggttaatacttagtatccacagtattttttcacaagttgagtaccacttttttcgtcagttacgcactaacaacatttgctctcattgatttgcttgtttaggaccggatgttgtggtaaattatcatttggatcctatgagttacgtcgctgttgaaatatttatgggctaacaaagcagacccaacagaaaatattagaaactaacttcttttcttttcatatgataagttctaagattggaattcggcccggcccactaaacattcatgcagacaattgttggcagagtatttttgttcacctccaaactcaactctctaattttgtttctttataaaatctgatatttttcaaaaatcctataaataactccaaggcttatgaatccaaaagagccaaacacatcacacaacaatatggtaaca

SEQ ID NO: 4096 - DNA, 2000 bp, Arabidopsis thaliana
aaattgtaggagcattataatcatatacccgtttgtctactccgggttgcaagtggcgcgacgatattagtgagtcagtggcatccacaaagatgataagaaacattctcgagattggcttggtccatgatcacatccaatcaccctgagaaaaacagtcccaacattaaatgctcgaggccgttttcaattttcgacaaaggttgttaatacaaactatgcttttgatttagggatatcttattccggttcacgagtgttatactacccctttatcaacatgatggactattgataacttaatttacaaatttttactcaattaagtagttttttattaatgattcattgccttcatgtttggagtttttttgtcaagagcttcaaatcaattgtgattaagtgaagttttgaccactaaaatgtcaccttgtagctgtaactctataattatattggctgagactcattgtcctaagaccaaaaataatttgttggtgcttaattggttgaaagaaaaaggagttatttggtaacacaacagggaggagttggtgagaattgagaacgacttaggaatgggttgcatccagcacacatttgacaaatcttttgtcgatttcatcaccacctttcgccaactttgacaaactctgcaaaattacaatatataattcaacattcgtttaccttaaatatactacacggcaagcatgactcggtttgacgtgttactgtgaggttacgactatcttcaactttttggaagtactttttatacattcaaaattatataaaggaaaatgattttataattgaggacctaatacgaatgcatgtaggttaggtgattagtaacatcggagacaagataagacagtacatgatcgggacgcaaatgaggtagaacataaagtatcaaaaactgaaaacttgcattttgttctaaatgtgtttctagattcatatagaatggaaacgtgacaaaacaatacagcaacaaaatgcttatgtaaaaactactttttcacggtaacaatataccaccacaaatcataaagtcagattgtaaggaaaaaactaaaattgatttgctgaaaatgtaaaattactatgtcggtcgtgagttatattttagggaggtgctttttgtcaaatcaccaaatctctataataatcatacttactgtaacaactttgtaaaactagattggtcttaaaagattaaccaaatcattcaaaaacaaaaagaacaatcctttaaattatgaacttgcttgttttttgttaaactaagttacgcttttgcgtatatagcaatcatagtacatgatgcattctatcaaaagaaaatcaaattataatctgcaaccatccttatttttatccctgacgtcggtttttggatttaatatatagaacttttacacgatatctctcttacgattaatctaatgtagatatgatttagaaaattaaaaagtaaaatctgcctaaaacagaaagaaaactaaaaaaatgtaagggatcccggagaaagtgggaacacaaagaaagtagaaaacaaagttgatgtgaactacagagactaaacagaaaccacaaagacacggccaaaaagacctactcctccactcacactcacttgtcttttgggttttgtctcgagacttggctccctccaaaccctaaaaaaattcaaatgaattcgacaacaccaaacccctaataatcttcatgaaatgatatttgttaggtcgagacaaaattatgttttgaatagtataagttatagtttcctaagtggttaatttggtcaatgacttgacttgctactagaattattgcttagacgttaactcaagtttttgtcacctaaaattcaaagtaaaccggaacaaaccgggcaattcgtaattaagaaatatagagagaaaaaaagatagacaatatttaaagacgtcaagtatgtatgtaacaaagagtctacactactaatg

SEQ ID NO: 4097 - DNA, 2000 bp, Arabidopsis thaliana
ctgtttataaaacttaatccaacatctttaattagtattcttaaatgtcaaagttcaaacaattctcattgcagatattacttcacggcacattgaaggaaagagactggacaaaacggtttggaacttgctaaatttctacgcatgcgctaagtaccatattaaggtacattagttctagtttttcaaataaaatataatagattttgtgttcttgtaattgaaaattttcaacctcgtattgtttaaatagtgctcgagagggtacatacagagacggatgagaaaaagaatggaaactttagttaaggtatttttatcatatattacgtacacacacgaatctacaacaatagttgacatttcataaacaaaataacgtatgtttgtaaatttacattatatacgtagctgctaaataacacaagcctagaagaagaagctgctcaaaatggtatcctttttttttgttacctttaaccttacttaggtttgtatatataaaaaagttatattatcattttttcttttccattctctaatttctatatagaaaacggaagatgcaaatacgtaaaggagtttgtgaaggtaccaaaaggtaaattgatgatgaaacaaagatgcaaggagatgacaaggagagtgaagataagcaagttccggatcaaaatcaacggttgtgctcggtttcgattcaatcagcggtggatatctctccccaaattctcttcgaaaccatcagataaatcatacacaaaattggactaagtaatcacttaacttggaaagtctcaagaaagaggctcggtgttgttgttttttttctttgtcaacatgctttaaaattgaattcggggagcaatattatacgttaatgaatatcttgacaacaaaaaaaaacgttatcagataaacttatggatataatttggtaaaccaaaaataaacctaatcaaaagttggcattgaatgcagcatgttacgtaagagctttgtacaagtaccattcactctttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagaga

SEQ ID NO: 4098 - DNA, 524 bp, Arabidopsis thaliana
ttaaagtcgatgttctatatgtattcaaaataatctggatttcaatcccacaaaacttaaggatatatatatatatatatatatagtctattttatataaatggagtatagtcaaataaatatgcattatcaacgatatatagtcttctattacatagatacgtgggagttcacccaacgtagatacgttcggttgaaacaagtcaatttcatcaatgcctcttccaaaaaaaaaacaaattgcattattgatgaacacatgcatcattatcaaataggttggttaaaatgaccaagatgactaaagccaatcacactactaccagatcgagtaaccattagggaccattaattcacgtggacgtagtgaatatggtccttgtgaattaatgagtacgtaattgtcctcattcatatatggatcggttccacaaacatttcctgtataaaattctacatctttcctctcattattatctctacacttctcatctctcaatcccattcgcttattatttatccat

SEQ ID NO: 4099 - DNA, 569 bp, Arabidopsis thaliana
tgagagtgattgcaggtgaaagttgtcaaatgttctcgttttctcgacggcataaccacatgatagaggacgagattacgctcaagttatgttgtggtgtacgttagtgttgcgtggggctattctgatcactagcacattaccaagttggttggttataccaactgtcaaacttataaaatagttttcaaatttggattcttagtttctaaaagttacaaattaaaacccaacatttcaaaaatgttctattagacccacctacccaaaaaataatttttgttcggtttctcaatcagttattctggtttagtttgaaattcgattagattggtatatttggattgtgtttgtcttattttaatagatgcgaaattcgaatatgttagaacgtttgaccaacaaaaatggttatactaaattaaattaatttgaatgtatcattacatcaatctggaggatagacgaaataaattataaataaacacgttaagaaaaccagtcatggacgatcgaaaaatcgagacttgcgaattcaacacggaagcgagacagtaaccgacttaaca

SEQ ID NO: 4100 - DNA, 2000 bp, Arabidopsis thaliana
tcatttatgatttagagaggaatgagatgactcaaaggattgttacagggccattagttgatgtcgtctttaagaaaatttgttggttgatgtcagttttctcggatgatatttctccaccttaacctacttgatacttaacacacaaaacccattaacacattgggcatgttttacataatgtcccaatggcccttttcctttagtgaccaagtcgcgtttcttctccttagtttcacaaacgatataatatcaagtggacagattaactggcctttttgtatcattacttaatttgaagaatggagcttcacttcatccttggaagagaaaggtaggctaagcgacagtagccaaatttcctctccacttacggtttccatgatattcttgatattttaccttcacaaggagcttgtatgtgtggtagttgaatggcatgaatctaagcaatgaaaattgcaagttttatatacataaaaatgttggaatcatcaaaaatgtagcagaacgatctcgactttgacatggaagctgcatattttaccttcaccaccttcgagcatggaagtcattacagttactgatgctaaagttgtggccatgttgattaggtccattaagctcccccctagtgctaatccaagtcctaatagcaaaattgtttgcatttttggttcaccatgtcctttggtttcacaatgagatcctctcgttttatactcgtacctgatatgcaacgatgcaaagtaagactgtgagaacacttgcttccataaaatattaaacaactaggaaaagcatgaggaatatcaagtcaagaggcaagtcgtttgttgttttagccacataataatattacgatcactcgaacagaccgaccaatagagctatattatgattaataggcacttaaatctgttttacattatgtgtatatccaatgtcctatgccaaccaaaaccaaactttttgggtaatatgtttataagaaatagtagacgctgttaaactttctgccccgaattactcttcaatcagacgaaatcaattttccattttttttctctttcatacgataccataagagagtttcctcctacggtgcgaccttctcatttatgtaatcgaacaactaaagcaatgttcctttaaaaaagcactcacttacgcattaagcaactacacgtacgcactcgcatatatacacttatatattttagcaaacaaaaaaaaatactagcatttatatattttggtgcaagaaaatatccataaaggtcttctgcaaacagagtcattgttctgtatgctatacacaaattaaagcctctcgtatacgattatacttctttaagatttttaactattattcatatttggctgagaaaacattaattatacacattttttcaagataaaccatttagtacaacaaatatagtatgaaaattacatacagttatattagtggaccactataatatacctctaaaacatgtataaattaatgtatagtttaagccttttgttgtggtggacaacggtgggattttaatcgctaattaatgattctacacaaaaaaaaataaaaaattaatggcgataaaaaccaaaatagttcatgaggggatccacctaacatgaaaaaatacgaccaattagtggaccgacgacgagtacagtgctccttaactaaccttcttcctaatttatcatttacgttcagactagtgtatacttttatttaagtataatttcgtttaaaaaaatgactagaagcttacagaaaaattgttatatacacaatacactatttaataagtctatgactcccatgcacttgacttacgtaacgagaacgcattcatcatcacctctcaattcattttcacgtctcctcttaattttcaactctttaagctcaccatatatacaaaactctgtttttgattttctctttgatcaaaatcaaaaaacgccgatcacaagttcacaac

SEQ ID NO: 4101 - DNA, 450 bp, Arabidopsis thaliana
cgtcgtcgaagaatcgctattccaccattgttaacttcatcatcttctctcctccgctccactatctcagccacttgtttcaatattgggcctaaacgaggcccaaatacgataatttggatccataattagtttatcacaattgggccttacggtcttcttatccgtccgagtcagcaagttatcctcttcaacacgactcacgaggcaccgagttggacttatcatgattcattatctacgcattgtttacattttggaatcgactttggtacataattgaatttatccatagaaatgatagagactcgaagatcggacataaaacttgctgacgtgacacccatacctttgtgtctgtatgtattatataaacgctatagaactaagagaagaagtatctaagtagcatcaaagcattctaaaagaagtttcaaagaagaagtgaaa

SEQ ID NO: 4102 - DNA, 2000 bp, Arabidopsis thaliana
tagtcgccgttacgtgtacgaaaattaatggagttggatcatttgtgtgtttgatctataaaattgtttaatctttggggtacaattatctcattctactcaaaagtagaaattctagagggataattttgtgcgatgttttcacatgaatttagtttgtttatttttttattactatcggatttttttttaatgaaaacatgtaatgtgatctcatatttccaagtgattcttctcttttctagttggttctaaaacttctaattcttttatattcccattttgatgaggtttgtcctaattgaacactacgactaggtggacaaaataatttgttaattaaataaaaattagttcaatatagaaatgaaaacgattgctttgtttggtatgtgtcggtacagtgaccatcctaatgcctaatataaaagattcgatcggtatgttacaagttgcgtgtatatgaaaacgtcacattttattaagtggcacgtcgttgtgatgaatctttcaaccgaacacgattcataatctataagcaaaatccgaaaatggtgccttctcaatgccccctatctgttcaatctttttttttttttttttttttgtatatctgttcaatcttatttaaatgtaatgacaaattaaatgaagtttacgttagtaatataagctgacaaacaacaccacattacatacataaaattaaattcttttaagtatttcaataacgtttctttatcttaaaaattaaatttacttcgagagcttcctacttcgtcaaaaataaaattttactttgctgcatgtttttactttctttttgtaacgtcttaaaaaggtgattaacgtcaacttaattcaccgaaagtctctgcaattgatattttctgccgacgtggcataagaagtccgattggcccacatgaccgacatccacgcttaaaccaatcaaaaccggccattcagttccatctgtgggctcctgaaacgttctcttgacacgtgtttaccatatattggcttaatccatccatagtctttctatttactgacaggtagtatttttcctatcaattatttattttcacgtggcatgatggctatggctagttgaacctgtgaataacttggtcatatctactctctatttatttagatgattcattttcttgaaggacttgcaattttatccccttacttttatttctttgagagataacctaaaattctcaaaatgagttggaaacatccctttgaagttcctctacaggctttctatgtgcataagaatctgcttaacattggaaataatatatgcattcttctccaattctcctagttggatacatatatgaagtctataaattacacatatttcccacaaaaattattgtaagagtttatatttcaacatatagtatgcaaacttaaatcgtgagaatgacacaaccactaattcaaaccactacattatatattctaatccattcaaattcattaattatacattatatatcatatctatataatgttataatatacaatcaaacaataaattagaaggaagtaccatgcaaccaaacttccatacgtctcccgtgaactaaaagtacattactatgcaaatatctaatataagttaactctatatcaatatattaaaaacataaatccttaaattaagaaaaaatatggggtgatttcattgatattcatccaccgaccgaccgacgtaaaagaaaatgggttcactctgcaacttaagaaatagtaaacgtcctttgccataatttaaaaaactaatgaaatctttaacagcgtgtgacctccgcgttggcctggaccctctacttcacacactataaagtcccactcatcacaacaatattcatcacacagctcttgaaaaccatcttaaagcaactcaaagctcaaatcgaaatttctagtttctctttatcattcacgctaagtgttcaatcgaatcaagattaagt

SEQ ID NO: 4103 - DNA, 2000 bp, Arabidopsis thaliana
ctaccaactatcacgtgccaaaaatctgggccctgagatatacctataagcaaaagccagctccgcccaaaacatttgatccatccattttcatttttattttccaattttgaagttagggtttatttttataagtttccattaatttattttcttattccttttcggaggatgtgtttattaatttaatttcaatagaagataatatatttgggttcaccactcgttctctttttctttttggatgggactcttcattgtgacttttttgttctcgctcttccacaatctttggatgtgtacaaaataatcgattgttggggatattatagtaaatttagcaatatgaaactagcaacgaagaaagtgtttattgatgggttcaaaatttcatcgatctgcatatcaataactcggaaagagatggatcatgacacatagtatacaataaattttataaatttcgaaaattaactaattgaggatagaaattcatcaattacttaataaataaataaaaaactgattcaaatgtatgttttacttctgtaacatacaatttcttgcttttcttgaaaattgactcgttttttatattggatattttacatagactttgagacttattaataaaactaactaaccatctcttacaaattgttggaataaattatttttatttttctgttggctctataaaatgaaaatgacctttgttcttcttctttatactcctatatatgttttctccagagagaaagagaaccattgaagttgcgagacttccaattatatatatagttcatgaaagtcctgtgaccatgctctttatttattttatttcactatacgttaaataaatggaaagtagggtaataatcatattgcagcatgattcattttagtggcgtctaagaagcattcattttgagccattaaatctcaaggtagactttcccattaacacaaaagaagaaaaaattggtacgtaatcataccaacatctacaaatctttggtttcaattttgtaacaaagacctagattgttgacaaacaaaaagcaaatacctaaaaggacttttattgacttctataaagatgttttgattgaaatttcatataatttaatagtttcctcaaactatatgcaataaaattataatttgataattacatgtgaaagaaaacatgactctcaaattaatatgagtcgattatcaataaatttttgtgatatggctgtgctgcagaacaactgaatgggcctagaagtaaagttgatattgagcaaacaaaaaacgaaatagattttttttttcttttgggcaaactcaaaaaacgaaatagatatgcctcgacaatactacaaaatctcaaatgaacaatattgatgaaaatgcgtttgtaacacagaaatcaattattttgaattattttccatatatagtacagacgtaaaaaacatactgtattatctttcatggaagtaaaataattttccaagaaatagaacaaatgtaaaacaggtggtggctaaaactggtgcttttaatggctaatgccattgaatcactgacaaaatgaccgatgacttcaacttaaaagttcaagcccacagttccaaaggtagaggaagtggtaaaatttaggtatggtctctttctctctctctcaattttctctttctacaaatatatactacagttacagtagtagttattattattaattattctctccccaatcaaacaacactcatcagagtcacacatgtgtcacttttttcttcaatattttagttttatgaataaaaaatcaaaataaaacaataaaaacttttttaacttggctagtttcccagtataaatagatgtatcaacgaacacatttaagaccacaaaagaaaccaagagctctcaaacaaaacagccttttacataagaacaaacacccccaaaaactgcaaaaaaaagagagagatcattaatccatcttcaag

SEQ ID NO: 4104 - DNA, 2000 bp, Arabidopsis thaliana
ctaataagaattactctatcatagcaccgtcgacgtgatcagagttagtgaatctggtcacaaactaacgccaaaaaccaaaacatagagctttttttactaaatatgtcagatttagaaaactacgacattatttcaactccctgacctaacttcagactcgatgaagaaaatgtcaaatcaagatagtggaaacaaccgtttgcgcaacccaactatccaaaactagttttagaaccgacatgaaccattgttaatctattcacttacattgaggttcaccctcaactggtatcatcgatcaccttcaattagtgtcctcgaccattgtattagtgaaggaacttctcaaaacaactgtaaaatttaccgctaagctgcatcaagattcagatcctctagctttcattactattgtagaaaaaaataatattgactaccgatttgtcgacgattcaacttgcactaaagactaaacagtgataaagaaaaaaaatataaaaaacatacttagatctggttttgtgtctttaaaaaaaaattaaaattttattaaaagaaaaaataattcgttcaatttttgacttctcaaatcaatttttacttatttatgattttacaaataccaaatctagccatttaccacatctatttttaatttagttgtgataagtataatatcaagaagattataattataattctcatagttataaaatatacacacatcatttacaaataatgacatatagaacataattttttttttacttatttgtagttttactattgcgttatgtttacaaataaatgtcaaacataaacaatctaatagaaatacactcttaatttaattagagtaagagatcaacaaaaatatagaattttctttatatcgaagtgctacgaccttatatatatagaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaaacaataacaataaaaaatcctaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattacgaatactatatgctacaacttgttattatttactccaatcatatatgataccaatcaagaatcactacataagtagaaaactttgcaatgagtccattaattaaaattaagaataaacttaaaattttatggtattttaagattccctttggattgaaatgacaagaaatcagcaaattagtcgtaactcgtaagaataaacaagatcaatttttactttctttacaaagattccgttgtaattttagaatttgttttttgtcactgtttttttatagattaatttatctgcatcaaaccgattaagaagtgtacacatgggcatctatatatatctaacaggtaaaacgtgtatgtacatgcataaggttttacgtgcttctataaatatatgtggcagtaaccataggagaaaaatcacacaaccaaagcgtttagaaaaaaacagcgataaaaccgaaacatcaagcaaacaaaaaaaaaagagaagagaaattatttttttttgttttcgttttcaaaaacaaaatctttgaattttatggcaacccgtcttctccgaacaaactttatccggcga

SEQ ID NO: 4105 - DNA, 2000 bp, Arabidopsis thaliana
ctatgtagaaaatatttacaataatgattagaatataaagatgctccaaacctcaatcgagtaccaacataaaattaattaaagggaaaatgtcaatgtctttaattttgtaattgatgtccaaagttcctagaaaaaagatagattacgattttatgtgcgacacgttgatgactacttttatggatttttttgttcaaccctcgattttgagttgacatcatgaagatttgatccatcattcgttggcccatatcgtttgaaaaatcaattctcaaatcaatcttaaatttcgcgtaattattttataaaaatgggcaatatatccattgtaagatttgtctatttcacgcgtcatttttctttctactttgttagatgtttttggttaatgtagaaaaacgattaaattagagacactatcaattagaagaaacaaaagtcttttgataaaactctactttgatcatccacgactgtgatcgataacttctaagcaaccttgaaacctgatcttttgagctttaactttaagtaggaaaatgtcatagtattggatttggtcgtctttagtttacattcaatctggaataaatttgtttctctagaaaaaataaagagccaaagaatcattatatatatttattgttctcatgtttatatacctattttttcttaatagtagctctttattatcaagagatttttaaaaacacctatattgtcataacattttcataaaatttttaaaaataaaatagaaaatcaaaacatttaccctttcaacaaaaagaaataataatgatattttatataaaaaaatataataaatgggtgggaaagagaaagcaaaagcgatctccaagatttgatacggtgtggtgtctaaaagagtgaaacagcaaattatgtttggaagattaaagaaaaaaaagaagaagagaggtaaagtccaattccccctttcattaatacaaattgttcccaacaaaatatttatgggtccctcttttagatttccctgggtcccgcggatccaaattttaatgtggacgtcaaatcctttttttttattattatttgtccactttcctcttcttcttttttttttttttgccatttgaaaacgatataaataaaagtgtttggataacataaaatttctagagtcatatggatggatatactactagttaggcgtatactaattttctcgtcaacccacaaaacccgatcttaatattattctatgaattgcatttgaaccataaattttaaattagaaactgaccaatcacatggaacaatataaaattgtcttagtggttagtacttaatacaaataagaccaatccgaagaaccgagccggttaagtttaaacacgctactatgaattgtaatggtgtatgaccaaaattagcttctttaatcttctggtttattattcttaacagtgagtgattccattttcagttttttttttccaatcacactaatgagtaatgacgagattttgactaagaagttgtatatatctcacgatggtatatttttattttttggattcctttgtacggatttcttctcctctattatttattcgattttaggaatattattttctctatgatattcgcataggccctccaccggattttccataaaatctctatttattaatactattgttttcaaagataaaagttcaattttttcaaccctaaaagcacggcacataaaaatatataattttcacattaataggaaccaaagattttgttggattttcctcgctggagatttttcaaaataaaaattgaaaaaaccaaaaagacacactcataaaagatttattttagagaacaaaaaaatcagaaatataaaaaactgtcttaaggaagagaaaggaacaaaagaaaacagatgtgagctcttcttcttcgtcttcttctctctattttattctcatcctctcctcacagttactataagctcgtct

SEQ ID NO: 4106 - DNA, 1021 bp, Arabidopsis thaliana
gcttttttcatattcatacatctatgtcccctttcttgattatatctacttcccttccatcattgtttgctgtttactatgtttttctatcgacaatatataagtacccttgttacccttggtgccacgtgcttcatatatgttagaaagggcaaaaaaattcgtcgtatgatatgcttagttaaattttataaaactcaataaaaatcttcagaaacagtgctatgatcattacatcttaactaagtgatatatatctgcgtgcctatttaacaaaataaacaaaaaaacaaaacaaaatatatttgggtgcatcatcaaatcaaagtagttgcaaaaactggacgaggtttttacttaaatggtccttaccccgcatggtccacttgctacctaattaaggattggtagggtgcgtatacgtatataaattgtggcggtgggagatggagttactaaaaacgaaacgtacaagtattattcatagctctcgtataaggggttagtccttagatctagatattttcacttttctttcatttatgtcggagcaacagacactagctggcgcttcaacgtgcatgatcttgattggctagtaaattccaagcatcaatacctaacacatgcccaacttggttcattagtattctttcattggtaaaatacccttacctttcaataatatccagaaataaatatatgaagccatccatcaaccggtgcatttcctcaaggcatggatatgatatcagaacatcgatgaaggtgggagggggtaattagctgagtgtcataaatgaggatccatgtggagatcatcgaatggtagtagtacatgtttggtcttagctggccccaccacaaggaattggactggtgggaagataggggtggttacgtcattccacatatctaccaattaaggagtttaatataaaccttgctatataatgtaccttggctcacaagagttgaagagacacagtgacgacacaaacatattacattcgacggtata

SEQ ID NO: 4107 - DNA, 2000 bp, Arabidopsis thaliana
aattcattaattgaccaactatataagtatgttatgaccagccggaagtaattaaattacgaatgatgtcgctttgtgaggactatgaggcgtttgaaagtcctttacttttacaaaatgacgtttggttaacattgtagggtacttgtaactaattgtgtgttttgtatattaaacacaatttttgcgttggcatacatttgaatattaggctgtttttatctgcttccttcaccgaacaaactgttatacgtcatctgtttttctattttcctttcacaaagtataagaatcttcttcgttatctgtttatttgataacgaaactggcttatacaaacatgacacggcatggatcttaacaattattagcgtctcaagtattgataaaataataataacagctacactcacgactcacgtcgcctaaatcaccacattatcatttttggtactagtatccaaactgttcggatatgtatttacagtctttgtaagagaatttcaatcatttatagctgaaggtgtaccatatagatagatagggacaccagcaatttttacatataaaaaagaaaaaaatatcaaacgatttacaatgtatcatgtcgcgattgggtcttgctgcctcaagaatagggctgatatctcgttttgtccaatcaaagaaaaaacacgtcatattcttattttgatgatttatatattagcattatccaaagtccaaagattataaactgagattcatcttctcgcccttgcacattgtagcaacgtgtgaggcatgtgcgatgcctatacctacaattcacatgtgatccggtatattaaaatatacatgatttatggatacactcgaatacttctccgatattcatttcgcggaaagttgcatatgatccactatctcctatatatttgttatataacacatggcaaatctctctatatatattttttaaatacacatatatccaaaataggcttaactataacacaaagacttttgtttactgtatattagtaagaagtaaatgtattttttaatattatgataaagtttgtgaaatcaccatttgcaatagccatatagggtcgtgttttaattttacagtttgtattgttataattcgattccaaggttgagaatatgtgtgtactattagactatacaaataataattcgttgacgatattgaatatttactaattataggaagagaaaattatttactaactatagtacgatatatttcttctatatgtgtttttaacgtttttttttttttaaatttaagtcttaactttacttctcatttttaatcaaaaggaaaaaaataccaatcaatttttcctaacacagtttacttatcattttcatttgaaatgtgttcactttctgataaaatgctaatcctacaatcaaatacaccattgtcgtgataacacgtgtacggctctaaagcaatcagaacaatcattggacagtttttacaccgtcagataagtacctatccacttgctgactcagccggataaaccctaaaccggaagtttgccccaccgtcaaaattggaagaaaccggacaaaagagaatgtaaagactaagaagtaagaacccatcggacgtcgtaagaaggttaattaacacgtggaaacagctggtcagagttatccggtaacttatccggttacaagtaaaaaaataatttgttcccatacacgactccttcagaaccaaacgcgacatcacggcgccgtttagtgtctataaatagagcaatcggtcgtagaaaaccaagacatcaaaaacacgaatatcgatagtacacttctacgtgcaattttctcctttctcttcctggacatctgtctgtttattacattttcttgtaatctctttttggggttttacaatatctatcccctaaagtttcggaaaattctgtttttctgttctcattcttcgtgatctttttcactttcttcaaaaaaaaaac

SEQ ID NO: 4108 - DNA, 2000 bp, Arabidopsis thaliana
agcaaatgatattacagaaaagttttactagagagtttcagatttacacatgcacaacgttaaaaaaaatagcagaaaaaagaaagaagaaaagttctttatttgtgagaaaaaatgtatgaaaaaaaaagagatgggtgtaaaaagcaaaaggataggaccactgttactttgtagcctcgttgaggaatctcttctcgcatctcgacttttgtgccattgcaaagtcaatgcccagaacttgttcccaggccatctccaattaactacgtctatttaattaaacttttaaaagaaaacctaataaattaaacaaaagaaaagccgtcaacgaaatctaagcttgcagcgatatcgatgaactgataccaaaacaatgttcaagtttcactttcaaattgttttttcttgaaatagtttattgggtaaggcccatagatatttcataagaagaacacttgtcgaggttgaatcgtatgtctgcccaccgcggcccatgcatcctctgttggtagcataatcgttttaggccatactattgttcgtacacactgattttgaagtcacctttgtgcactccttaattcctaaattgaagaagcttgttctcattcttctttgggttacaaatgccaaggcaaaaggaacttgggccaaattaagacaacaactcaagcccactctctgcaaataatacttgggaatttttagtaaaacggtgcgtttcatccaagaatctattaatatccctaacttgaaatcatcatatacgtaacccaacatattaaagagttaataatgttaaaaaaagtctcagaagagagagacgtagagaacacggaaagtggtaactggtaagcgtcgtcatcgaggatatagtagctacgtgagcaaacgtcttcactcatctctgtctatttctcttcgaatacacgtaatacattttcgattggattgatcctccctcggtcctatccaagtatccatccacgtaaacaagagcttgttcctttcttgtttttgctttctttaaatagtaaaaatacttatttcatttgtttcgtttgatttcattattattgtctatggcattatatactatatatattatttttacaacattggctggctcacgttgttctcgtgtatacaacaaacttaattaatgtctctctattgcattagatagtttcggagcatatccattatgtgaaagccacattaagttataactaaaagtagttttcgaaagagcttaattaagttatgttctgtttcaaaaaaaaatgaacacgaggatttttttttttttttgacagatcattattaacaaaaatgattacctgaagaaaggggaaaataattatagctgattacagatcattattaacaaaaagaattcttgtcacatcatacattataacaagaaatattatattatattaatttaatctttcgctaacacgcccacaatatattaatcatatacgtaatttagcttataaaaaggacggaaagagattattactgcgcctaaaaaactcactaattccaaagaaaaaaaaaaacttgtattttttcttgacaaaccagctcacaggcattgcatgatcaaactcatcaggtacgttttgattccttcttccataattttcccatcttgaggaatgcaaatttggagagcgctttagctaaatcactgccttcattttttcactttggatttaataatttgcgttcctctcttcctctctgctctgttctgttctgttctgttctgatttgagttttcaattaatcgctcgagcaaaagctatttctcaactcgttaaatttctgttcccagtttgttcgattttcaacagtttcacattaaagtttgggtttttgatgtttggttgatgaaactcgaaatatgaaatgtttgtgaatctattccagggtgtttaaaataagggtttgttgttcatctgcagagattatatgtttttacatgaaag

SEQ ID NO: 4109 - DNA, 2000 bp, Arabidopsis thaliana
acaattagaaaaatgaaaaaaaataaaagaagaagatatatatggaaatattggcatttgtcttaataatgtaatcaatcatcaattgtagaagccaaaggcatctctagtgtcaacgaatttgaattgatataccaactaacatactttcaaaaccggtagattatacggtattggaagatgatgaaaagaagagtttatttctcttcaaaagttacaaattatataaatgtcatataccgtaagatgagatagttgaatattcacgtggtgtttatagtgtctacataggtaaaagacattaatcatacaatcgtattaacaaaattgattgtaaaaaaaaaaaaaaaagggttgattgtaagttcgtaacctctatgtggactgtgtggcccaaaccaatcggtcggaagctacaatactgtgtccgaatcctaaaaggctaaaaactgactcggaccagcttagagatcatatgaaattatggatagcggaatagctggcaacttcaatgaattctgaatttaaaacatttttttttatatatatagatgatttggcgattttcgaactggaatggtgaaaaagtggttgagtacactattagtttatttatttaaaaaatagagggaaattcaaatgaaaaaaaaagtttcatctacagaaaaaaaaacacgtcaaaattccaaaaaacttgaacgtcttgaacaacggtataaccgtataagaaagggaacttaaaacttaaacgtctacatgattgaaagggtaaaaatattcatattacaatggtataagaaaatggagaagccagaggagcaactccaaagaagaagatgcagcaagagagtgtacattattataattataagttggtatatatgtagttgctaaaaaaaaaaaagagtgtacaatattttctgaagaagcatcgagctggttaatatttaagacccaccaaaacctaccaacaatgttattctcatctctaagcaaaagtttgatctcatctttttttttaattttttttttgatgggtcctcttctacctctgcatctccacgtgctatacaagtggcctcgctgtatgtattatttaccactctcttattgttactaaaaacttgaatgtcacttgaatgtcacttgaatgcaaactatatatttaggtgaataccagatcaaatagcaataaataaaccaacaatttatgctaattaaaaacttgaaaaaacactttccattacctatgattttttaatccaatcttggggtttgatgcccataaaacgaagtcgaaaagagaaaagcgaccttaattgtaataaatgcagctattgacttctctatcaacttcaagtcttcaagtaactacaaatttaataatctccttagcttatcttagagaagcacaaaacaaaagggtctacgcttagtcttcctagattcttgatttgagtcttgatggccacttgctttttatgtctcaatcctaagagttgatacttacttagtattaatcaggtttcacattatctcagacctagcttgcatttttgatacaaacatgtcatgcaatacacataagcaacacgtaccgagtcattgattgaaaaacatgacctaaatagtaatacggactgagagagagtgatgaatcatttcatatgggagacagctttctcatacgcgtccatgcctttgcatgaaagattaaataattcaactctttcacttatcttattttaatttactttgcagaattccaagttttattgcaatcaccaggggtattaaatgggatagtgtaaatgcacctgcaacacatcaactaaccacacactcctccacctgtttgtatttacttcaaaaacttaattcaaaaatccctttgcttctttccttccctctatttataaaccctagtatccggtttttattctaccacacaataccatttgcaacaaacttctctctgaatctcagtgaattctcataaa

SEQ ID NO: 4110 - DNA, 2000 bp, Arabidopsis thaliana
aggaattgagtcctcgtcacatggggcccacataaatgcgtaagtaagactatccgcttaccagacggacacgtcattttgtcgggacacgtttgagccgttggatgattaatctccttttctgacttatcgaccccactttttttttccactacaaaatattgatggccacgtcagatgattcgaagttatataaaacacacgtttttattgcagcttaaccgtcgatttttttctaatcgagaaaccgagatcaacggtctatattcaaagctgatgtggtctgtacctttgcttacgtcaccgaaaacctaagttgaataatactagtactagtattatgctctctgatttctttctacagtacacaaaataaaaataaacaaaaatagagagcccagacaatatttactacatcacccaatggataaccgacacgtagatacatccatgtgagtcgcattttgtaatgtagggaccacttcgtggatagaagctcttttacgccaacgcaaaaaaaaaaagcctcgttggccctttagcctctaaatgccaataactatctactggcgtggcttagtttataccgttggatcatttgtttatcccagccgttggattcgaagcagttgtcgggcttgtgggccttttctttattgttttgttttcataataatgaaagaaaataaactaaaaaagtattttttatttttccttttatggtgattccatgatggcaaaaacgtggccatacacgtgggtcgtctcgtggcacctttggaagatacgaatcggtagtgaataatggacggttcggatctttagttttgtcgacagaagtgctctccgcgtcggagatactactagtcaaaggtcttttcttccttcgtattttaccataatgtcccttctttctaatcaaatttttatcatgtatccaaattattcgaagcaatattctatataataaacaaatatgcccatcggtaagtagcaaaagttaaattgtgtttattttcatgccatacaaaaataatgattctgaaaattcgttggaaagattgtttagttttcttatttttatgttgcacatgacttcactgacgtgtgaatgtgatgacggattttgaagaggattatacactatggtaaatatcgactataaaaataatctaaacatgagggaagcgtagagcgactagaaatcgaacacgtgtacggtagagatgacataagaaatggctggcactaaactcgatgagccaactcatcaaacaccaccgtagtttacgctgttatatattctcatgacacgtgtctgatgacgtggtcatcgtcttggcgctccgttttttttctctctctctcgcgtctcccttccctcaaaaaaaaaaactgaactctttttcgctctggtttttttagagagagagaaagatgaaaatgcgtttaattgctgtttaggtttcgaattcgcgatttaaatttctgggtttctctctgtttaagcttcttcttcttcatcttctgcttacgtttcttcttcaaggagctttcggattcttgtaggtattgcgtaacttaaatggttcaaatagagattgtttggtcgaatagttttgtgatttggtttctctatcattcattgatcttctaagttttgtgaaaattttgccatttttgatcgtttgcttttgcatttacttgaattgaatgaaaaattataagttttgaatttgaacaaaaacagctaaagcgtagagaagaacagagtttctttttttgggtgcatgtgattgtttcaggggtagaattgtccagtagtgtctactttgttgattccttttgtcttcctgaaagttttctgaacataggatgtgagagagaaatactattttacccttctctgtctctatatttctcacacaacaacacccatccccatgattttgcagaaagagtcattgttctcttgagtgggaaaccttgaaaccattcct

SEQ ID NO: 4111 - DNA, 1643 bp, Arabidopsis thaliana
gtccttatgaacatgagatgaggagtctcttaagttagtctcttttgtgtcttttctctgtgtttttttttttccttttggcctttcaagtttttgagaggatctttttgtttggcaacaataatcaaactttgtaaaacttaaggttcatgagggtattatcatataaatatcctcttttgtaaaatcaaatcattgagtttttggtaagacaaccttctaattgtaccaatttgttttgttagagagagagagagagagggtctttcttaggcttgaaggtggagaatgtggggaatgtgaattatgaatcttaacttgcaaatgaatagaaacaatggtttgaatcatgagtgatatcatttcaatgtcttgttgtgaatctatacgtgatccttgtgacgtatgattactacccttcatcaatccatagattacaccaataatttaagtggatttcatatattagagagatggcaactcgatgaatatatgacatattataatatcacatattataattcataactgatagggacacaaaataagcgacctaaagaagaaaatgggtttgaagataagtgataggaaggtaggcgacaccattgcttttgatctaagtgtttggtccctatactttctttttttccctattaattatatatctatacattatctataatgcgtgacataattcaagagaatcaatactatttcgattttttttttttgaagaacttgaaaaaatatatccaaaattagaccgatttcaataacacaccgtacaggttgctttgaggtttccatttcattggttctttgggaaacatcaataacaagctgcttatgagatgagaagagtaaatgcttcaaatgccaaaatacttaacgttgagagtatctgttgttttttgcaatttccacaaaaaagttttagaaagtttttgattcaatgggtttcaggatgtattcttttgtaaagaagtttgtgtcaatgcattcatgttgcaattaggcattttgtcgaatcacgaaaacggaaggaacactcgtattcgtcacatcaaagtataaggccctagatcgtgtgtatcacgtctctaatttgcttacttacaaaactgtgttgtttgctcttttcactaatgatggatctatgtgataacaggaatcacattccacgtcaattatttctgtttacttcaaaagaatgtcacacctatgcaacagtgagacaagatctgaggaagagagttagagaacatgaaatttaagaaagagtgcttcaatatcttgttgtgtacaaatcaatagttctgtttgataatatcaacttgacagcttttgtcaaaatgatgagtaaaaaatcaggatctttgggacaaatacggctgaaccggccggtttagctaagtcgaaattaccggcctaatcgttaaaccataaaaaccgcaactttcagaaacactctgcttcgtcgagcggattcgacttgtctggctcaggggtcgccacaactctcccgcaagttcacacatacactcggtgctcaaaaagtttgtcctttttgcatctctcagttctgaaatatctggttctcttgtccttgaaaattttacgaggttgttctctgtgaataatcg

SEQ ID NO: 4112 - DNA, 2000 bp, Arabidopsis thaliana
ttgttgccgacttcttgtttctaatttttgtgttggaacccactcgtttttttattctcgtaagagctttgatttttgatgttgtcgttgcgtatatgccccaaaaggtttttgattaaactagtgtgataatgacttattatcagcaaatgctatttttagtgttcagtgaccgacatgaaatcaaaaagtttcctaagtggagcgaagagattcgtacacgtaaaccagttgagaatttggtaccttcttcacaacagataggcgtagatagatagatactgggcccgtaatgcgacgtagcaatttcctaatatcaatatcaatcatgatttcctgtaacatgcggttacaaaatagcttcgtcgaaactaatcttcttttaattatcgattgattattaaatcaattcaaaaccaaaactaattgaaaattttaaagcttgagggggactaatagtaacgtgagattgaagtaatgccaccgaatataagggttgagtaagggcgctacacgccatcacataaaagggattatactatcaatcaactaatatttttgtaacttaaaatgaaataccaaagtttcgacattattggtttatgaaagctcaccattgtattttaatttgatcaaaactatacattttagttgagaccgtaagtacaacaaaggtccaagcttgaaaatacttttttagacaattttatcatttactaaatagaataattattatttgtccccaccaagggtttatactttatatcagtttatctgtagataatgttttaaatctgttcatatccaatattttactaaatataaaaaaattgtttttctggttaatcagtttttaattttattttgaaccaaaagtatgaatcataatttttagatttaagatactataagtagtgcaatcattaatttaaaacttgcttatatagttataacttatatggttaatattgtatatcccataaaataatactaattaccttggtggtcaaatcatgaaaatcttattataaaagggctaatgggaaatattcttaagaaaatccagagtttccttgtacgatatggtttgtgattaatgaatataaatacaaaaaagtttgattaacaaccaaaataacaattaaagtaaagaaaattgtgatcccttgattttatctctctgataaagtcgcctctttcgtcgcagctagtcttcttcgtcgccatcagaaaattctcattcaacacaaaacctcaaaaagttttcccagaaatcctatcaaaagaaggactatatcaagcttctgtttctgttttttaggtaactaatgatttttttcttctccgttacaaaagtcactttatatttttgttttgtaggatcactaactctgtttgtgaggttcttcttttctgttttcgtttgttctgtttggttgttctgagattttttttttttttttttttacttctgtttcagcccacttttttagtttccaggttttactgttttttatttttttaaccactctgttttcagttcttcgtctattagggtttggtaactaatagtatctctgttatggtaaaccaagttttttttttcatttgaaagctcaagatgttcttaggatcatatgattttccatgagtattcaacatgaaatttactttcttcataatgaacctcataagtacacgagagtctttaatcttatatttgtcatcacaatggatacacatatttgtattgctttaatctctgtgactattattctctcattgttagtgtatagttagctatgttacattgaagtacttgtggtgtttgagtttggttttccagttacttagtatgatcacagagctagattttgcctcccattagagtttcaattaggagtcttatgaattttttctggatactacaggtcttttggtaacctaaagagctgctatacactgatctgagaactgtcaaaactttatcataccaaaga

SEQ ID NO: 4113 - DNA, 500 bp, Arabidopsis thaliana
aaaggaacgaaaccaacagaatttggatttgctataaaaattaataaaacgtattagtatctgaataatgatgatgatggatgttatcaggattttaggtcttgtagtataagcaaaatggggttgatggtcggaagatataattaatgaaaatatgtttgtgtttttttattttgaacacctaaagtaaacatctgaactagcaaaacgagcaattaaacatctgaccacataaataatccattttttatctctattttaacctcgtagttagataattaatttatgaccaaaaagaaagtaaataactaaaatgagaaaatgaaaaccacgagctcccaaatttcctgcggcttctttagcctcttgtttcgtttatgtaccactttctcgactccacactttataaaccaaatcctccacgaaactccaaacacattgtccaaagatcaatacacactgttttaagaagaatttgaaaagaaaaagaaaaaaagaag

SEQ ID NO: 4114 - DNA, 1291 bp, Arabidopsis thaliana
ttattagtcatgtgtgatgtttgtaaaagtaagaaaatgtctttgcagagacatgaaagacactggatcttcctcctaaaagcactaaataacattttattttattttttatttaaaaaaaaaatttaaaaacactgtatttttttgtgcaatgaggatggtctaagaagctgatcaaagaaagatgaaaagaggtacaattattttatatactatctctgtcatgaatcttgcccattataatacattaagagaagcagttctttttattcttttcatgctctacatgttaaggtcagccaatgaaagagcacttgcactttcgaattttgatgaagagaaaacgcatgaacaacgggtctgtctaaactcttgtatgccacaaatatttatctaaagtcttcatcccaagcaaaccatctaatcagtgaagactcttataatcacattaaagttttcttcaaaaaatcatatactggtttttcaagacatcgacatcaaagttagactcaaatttctcacagacatctcagtccagcttggcccaatatcatcaaatcaatgaaatttcagtccagctgagcagatatagttggaaatttattaaattaatgacagagagtttacaaaatttagacccaaatgaaagaagaagatagctagtatacaaaattagttaataaattaaataaatatgtgaaaacacccttagctcactggctaaagggttaaaggtttgtctaatttgtcgttgtaaatgttttaagtgctaagtttccaacattccacgtattatataacataaggattagtcttagtcaggactttagtttggtatcttcgattataaatttttttttttttgtcttgcataactcttagcttacgcaatgcaagtcaatcatctaaatatccaataattgtttactgtattttcttttattatttattatttatttgtaaagtactgtattatttttctgacgttgaccaaaaaccacacaaaaaaatgcttttaacaaagtaattttttatttttattttaaatactttaaacaaagaattgtgaataagactgtaggaattagcaactagctttaaagaaagaagagttatggttttattagcttttctttataacaaactgaaaacgaaatcacaactatcgacaatgactaattgatgagaagaaaagaaacaaaagaaaacaaatttcttcagactttgtattctaccaaacaagaaatctaagccaaaacattcaaagcgatttctcaagcaaaactagaag

SEQ ID NO: 4115 - DNA, 2000 bp, Arabidopsis thaliana
attctatattttctctttttgtttttttttgtttttattttctgatgataaagtaactatcatatatagataacaatttcttttagtttttttggtgccatattttcacgcaattaggttgaaccactgtcattattttttatccaaaacaatggtcaatccaaaccaaagttgtattgaccatttctgtattacatctataaaaatcctcgagttttgttgatagttatttaaatttactgtatagctaaaaaaataaatcaatatactagttcaactaaatcttaagactttatactctataaaataagttttgtttagttaaagtataaaataaagaaactatataattgcctaacgtgcactccacaatggtacagtcttagttcgtgatctccgcatacattttattagacaataatgtatttgtgtggattgtgtaaatatgcatcttgacgttttaaaaaaaaaaacataactgtctgtatacgaaactaatacattcataacgtgtttatcttaagtaatggtttggtaaatagtagtatagtagttaacaatttgatataatatggtttgtaaacctaaactttggtatttttgaaacttttcaaaaatagtaaagttttagacaatttttcagtatattctagccttctaggatacactcttaaaagaaaacgtttttaaaatttaatatatataaccttctatctgtcttttgtggtatattataatgtggcaagtttaacaaatctttagaactgagacaaaaaaaattggtatacttggtcaatttctggttaactcaatttgaatgggtactcttaaacacacttgacacttttctgtaaattgtaatgtgtatatatcattagctgttggactccgcggtttaacaaaccgtgtttgcttttctgccttttagctgtaatccatcgatacagacttattattctttaacttgtgcttcttatcttactcgtgagcacgttattcaatttttattcatttcttattacatataattaatttgttgctttcatgtttcagtttgatcacttccttattaatagtatatactttcaaccttatatagattactaagtcaagttttaattatttttacagtatttctatccttattaactcattgtttggttttaattttttttttttttttgaaaattttagtatagaactggggataaatattcaaattgtttcaaattaaccgctgttaaggtttaaaagataaacaaaatatccaaatttttcaaaactttcatacttatagaaaaaactaataaatgtttgtaacataatcgtaagaatcacatatatgatacatatgtttatggtctagttgaaagatttaatataaaattagaagacctatgttagaatctccacactacagtttgcaactattattaactattgtgaaatatctaaaatagcaaaaatactctggatttctgtataagattttatgatttagaaaaaaaaacagtaatcaatatttcttcataatatacatcttaataatcacacgaatcttttctttataagttataaaagaaatagcctgcaaaactacaccacataaattctctaaacataactatctgaaatattttattccatattaatatgttcaagtcagagatttctctcttcattagttcatataaaacttcttattcttggctttagacaaattcaacactaatcacgtcttgattttattaccaactttaagcatttgaaaaaaaaaaccagtggatttcgtgtgggccctgcataagcagcgcgtgcaatcaatttgttttttttctctacgcgttttcgccaccttatttattttcatgcgttcatatatttttctcattaattcacatttaaacacttctctgcatatatttgcttctccgtttctcatttctcaactctcaaactcaaatcacttcctttgtctcagtgactctagtctatctcca

SEQ ID NO: 4116 - DNA, 2000 bp, Arabidopsis thaliana
ttaaccaacctccctcgtagaaaatttcaaagaaaggataacaaaacaagaaaaagcacaaagttgaaaaagaagtgacagatgcagaagaattggtcaaaatcattttgacaaaactacataaaaaacaatcaaatgtcactttcaaaattattagcttatttattattttattatgaaaataatgaaagcgacttctatctgggactggtaaaaggacctctctcaccattggttgtacattagctgtcaaatttttacatttccattacattccctaactccaaatatatacactaaactaaattcttcaagttacttcctaattactactatagtaattatttcctaaccgtcaaatagtactgaataacacatataatatagtttcgattgattaagagatttgaattaaacagaataaagttttacgattatatattctaacaatttatttgtctcacaaaaaaatctatagatttaatgagaattaaatgaagaggacgaaaggaaaaacaaaatgaagaaaaagacatatgaaacgtagtcccctcttttctttgctttcttctctacataaaactaaaactcctctctttcacgaccctttaagtaacgacgccgttttcatccaaacacaaacctctggaatcgtgtcaccgttggagctccggcttcattaatggctttcttcaagacctgaagacaaaagaaagtaaaaatatatatacactagagagaccaagatcctcgtttatgggtttcatcgtgtcttgtgcttagggtgacataaatacccatttagagagcttagaccaagaagttttagagtttgtgaagttacttgttggttagtctgctgtttctggcaaatgctgagtctcttctctctgtaagttcttttttcttcatttactctgttttgttccccatttttggtctttttgacttaacttagagtattttaaggcaaaataaaatcatgaatcttttggtattttttgttctcatcttcttgtggggtttttctattgaagtttgcttagctttgaatcttgtctaatggagctaactcgatccaaaataaaaacacgtataatgattaactagttctgctcattagatgaactaaattaatgagttaattccgtagtttcatgcatcctacaatgtattgtctatgtatggaagcaaagtatgatatcatatttaaacatctatgattgtgctactaaactttaaataatactttaagctgatgtgatcttatatggataacctctgaccattatctactttctttgaccattgctcttgttttctaatccaaaagtcgtatcttccaatgcattagttggtccaaacctagatttgcatcccttaatttgtagtagttaacatctaattttgatgttaaaaccaagacaccactttgtttgtctggtctgagaatatctcaaggcgtatagttttgtccttatgacgcttgcaaaagcaagttgttgagttgtaatcttatgtttttttctgcaacttgccttggatgaagccatgagattatctttataaatggtagcaagtaaaccggtttcttatgtcgaaaaaccgatcatttttgttttgtttgatgacaaggaatggaatactctagagactcggcagagatgatgatggagactaagcgcaatgtctactcgcttgaagataacaaaattaaacgacacaagtcatctgatctctctttctcttccaaggtcttgtgatacatcaaaatcaaaattcattgtggctatgaagctaccggacatttctgtaccagcatgctaatgatcttgaaactttgttgttctgtggtttaaacaggagaggaaagacaaattagcagaacgtatttcagctcttcaacaactagtttccccttacggaaaggtactacttggtccgaaataatctttcttacacgctctttgtcttctctagccatgttcaagtctctatct

SEQ ID NO: 4117 - DNA, 859 bp, Arabidopsis thaliana
gatatgtatgctgattctaaaccggttaatcaaactaaaccagaccgaatgtctctacggcctgactggtctatgtgtcagttagttcccacgcgagtgatgtatttatttctacgtaacattgtgaacctgcttaaacgcttactagattgaaacgaagaccgtgagtaataaagtctcctctttcctagtgcaagtatgtcagctaaagtgttgctgtgtttttttacgatatttttcatgttattcggaatgtcttaaatcacaaaaaatattcgacttttcacaagcatcggatgcatagttgtttatttgataagggtatctcccatagctagttaaaaatgttatttaatatattcgttttggtaccatatgctacaataatcatattatgcagagatcatcgaataacatcacataaggtaagaaagttcatgtaaaaagaaaatgcactaataatcattcacaaacttagcagtagattagcgatcgaaaattgatgtcaccaaatttaacaatctttaaaatgacatcttttaattaacgacgttcattcggagacaaaatgaatttcatcaaaaatgagtcactaaactatttttcaaccactccactaaaaaagttaaacctcattcaaaaactgccacgaaacattcccaccaacaaaagataacaaataatatagactccctcgccttgttgcttcccactacaaaagtaacaagaaaaattgttacaatactaagcatagtattaacgttatgctatatatacaaatctctcgtcggaccaaatattcgcattcatagatttcattacaaattaacgaactattcacagaaagaaataaaacgag

SEQ ID NO: 4118 - DNA, 1371 bp, Arabidopsis thaliana
ttctttagtcgggtcggagattttttccgggtggattcttttctcatacggataaagaacatcatttggaaggagtgtggcccaataacaactttgaatgctcaattgggcctatctttataattggcctgtactatatgtctctcttaccgtcctttttttttgggtgcaaaaaatctcttaccgtcgttaatacacgttttataactgttggcttatgtttagttttataatcgccaggttacatttaaagaatgattagtaggagcaaacaatttataaaaactaaagagataatgagagataaataataagtgacagagtcagtattttgtcgtgaatgggaaacagccaaacaaggctttatgattcgtactaatcacaagattcacagatcaaaaaatcacaaagttccaagaagcaaagacgaaaaacacaactcatcatcgtgtccttgaagttatggtcatagattcgcacaccatgttcctctagattaaccaaaatgattttttatgaacaaaaaagattcacatggtcactttactgtatcttgtatgtgaaattttacatctcatttttcttaaagaatgttttacttttacatactatcaatttacttttatttttcggttatgaattgaagtggatgacttacttacttttgaaattcgaatgaagaaaaatagaattgattcctatttcagttgttcacatgtaaacacgttatatacttatatggcaacttgactaaagggaaaatttaaataaaatgatttaatttggtgacatatattcatctttctaatttttgtagctactacacaccgtgtatcctttttcataataatgatgtgaaattgtataattgtaagaaaaaatgagaaaagagtgacgaaatctttaaaacagacagaatttttttggttgagcaaacaaaacttagttatcaaattttggaaataacgtgttgaagtggctgattcttttacctacaatgattgattcatcgacaaatatcttgttcgtatatcatcaattctaaattcttcaaaaataaagtaaagatactcaaatgtaatgaaatgacgaagctggaaaaacgtattttaatttaattcattatttgaccaacaatttgcatcatgtgaatttaaatcttgataggtcaatattagtataaactaccacactacatgcgaaaatcattcctcatttagtgcaattacaaatgataaacggaaacgttatcatttgtatttattttgtaaaatatgtaattcaagaaactgctcagaatataaagacaagaatcctctttcttccatctctatctctccgtaaacagttgctcaaaaccttcttcctgaa

SEQ ID NO: 4119 - DNA, 2000 bp, Arabidopsis thaliana
atgaagatgtctttatgaaaaaaagaagtggggctttaatttttgttcaaagtgtatccaataacaaaattagaattgaaatgaaaccacatatacatacttttggttagaaagagacaagacataaataaagtgagaaacacattaacaaagagaagttgtggaagtagaagccatttctcaatctcttagtgaagaagtaatggtttcttctatatttttaattatgaattggagaagtagcatgttttgtgtggaaataagaaaaatgatatagattttataagtttcttaatatgcgactagaatagtatatattttatatcctaaagtatttttatttggcaccatagacatactttgtaccaatcattcaagtcctaaaacctttttgcaacaaaattcatttaaatatggtgatacgcattactttaagagattaatttgttgtgatcgaaatcaatgaaactttaaatgatggacatataaaactaatggtgggctgctttatgactcgagtaaataattacaaatggatgagatagctagtgctgtagtgcatgatctattttaccaatgaaacaacagatgtgattactaatttaatcataacttaatgagacatatcccacgcatatacgcaagtatctatcgcaatttgcatctatctatgtagaaagtttttagtcacttctacttgtcaacaatggttgcattttgcatgcatataataacacaacaaaattacaaatcattgtaagtgagtatatttcttttgtttccatagttaaaactattacatcttgttgcttctaatatgactactagtctacttctacttgtagaggtaatatctaatgccctttgcttaaaattcattttcactgcaaggaaatgtaaataacgcaaccataaattggagtattataattataacaagtgaagcatggctttttaactaacatattctttaggaactgcacactttccatgatcaaatagtatttataagaaaaagtgaatatgttacttgtttaattggcatactataacagagtgaaccacaattttgaattacctattaaaattatataataaattaatcatagtacatttttagtttgaccaaataaaataaaattaactacacatttattttgccaaaacaatcggttccaaatcattagcttctcatcatctcatttttcttcttcttactgtttattagtgaaagagctaatcttctttaaactagatatttctccaactaatcttctttattttgcaattaaaatatttgtgttaattttttaaaaaataaatattttaaagtttacttgtcaaacttctgaaaagtaaatcactaaccattacagcatctggttcgattgtttcaacgttgttatttacaagacaacaagagttatggtaatgatttttgcttgttaaaatataagctttatattactaaactattatgattttgctttgatgatacaaatcatatatcttacatataaacgtaaatacaatcttaaaaatacaacaagacaatggagtctatggagtcaaatgaaaatataaggacacaaaactatgatttttattagattttcagttcaagtagattcataatttaagggtgaaagatgaattaatttttctgtttttgtcaaataagaacataataactgtaatccaattgaaaaaagaaatggttcgtggaaaaagaaagcaaagcactcagtgactctttataaatactctcattgcaaagttacattctttcaagctaacaaaaaacacacaaacaaagagagagagaaaaacagacacacactcttctctgtttttttttgctccacaaacttaaaatcaaattctcctttttctctacaacatctttgtttgatcttcaaagaagatttaagcttgaagttacaaagcttctctccttcagatcctactgttttaagttaatctttttcccttcaacgcca

SEQ ID NO: 4120 - DNA, 2000 bp, Arabidopsis thaliana
ttcatcgaatggaatcaaatgtctcatagtcatattttaaaaaggatctacttagaaaacttcattcacatactgtacttacccatttagtgatgacgtacgaggtaagatgcaaattgttttctcaacacaaaaacactaaagcaaagttgaggaataagttggtgtatagagtgaggaatcagatttggtaggaagacagaattattaggttgtattacatctgtataattaaagagaaagagagagaacatattcttcaaagtgcaacgcgtaattttcaatccatttgtttttgtgaaagtgggacgtctcttacctctcaaaggtcgtaatcagctttttgtacatatgacgcagaaaccgcaatcttttgttttaaaaacaaacgatagataatgaaagaaatttaaaataaatgaggtcaacgtaagtggaatactcatgataacaatggacgtggaaaaatatcaatagtaaaataatttcagaacttttaattgtataaaatttagtggaattttgttgggatggttttatttttcttcccaccgctaattgcttctccgccacacacctccttatgtttaatcatttattatcatgaatcatgatatagtggtcctccttcatcatatcaaaattaaaaaccaaagattggttcaaaactcaattttttcttaactcggttatatttttttgtatatattttaacttttgcaatccactcgttcttatcttccactagattatcttttcctcgactcaatgttcatggtaataaattattcaaaacttgattgtcttttaaaataaattaaatcggatgtttgatatataattggactaataaggagctcatgaccaaaaatattggaattcggacacctgcgagaaactgatccacaaagtgatctttaaactttctttctttttggttttaatagaaatccttaaacttcatatcaccaatatattgattatcttagagagtagatcatatatttctttctttctttttatttcggtttaaatcatatattactttcggttcggacacatgtagtctgttgttgaaaggaacaaatcaaatactttcggttcaatatggagaggaaacaaaaacgataatcctgcagaaatagaaatataagaacatggaaaatatttcaaatagagactcctgtttcccactatgaaaagatgcactggaagtgtcgatggattatggcccgtaggttttcgttactatagattctttactttttgtgtactgatcagcacattaatattctctagttataataacaaaaatgtagagggaaaccaagagagaaagattcgagaaatgttttatttttattttttgacatcgattcgagaaatgtttaacccgggaattgataaaataaaatagaggagagtgttagtataagattttaaaacttgggttatcaattaagaaaaagaaaatacaattgccaaactatatactaagttgctaacagtatagtttctgtaaaattcatgaaaatatagagcatacgaactagagttagtgtcaaatttatattattcatgagaccataagctattttgtagggccaatattggccagaacaggaatcaaaaacaaggtttcaatataatattttgttggagtctaggtgaatgaaaaccggccgttattataatatttgattatagaaaggaatcaatccattaatttgcatgaatacataaaaaaaaatggacctaaattgaagagaagatatcttatagtaatagactgaaagtgatatctctctagtggaaaacaagaagatgagagaccattcttttcatttgagaaccacattctctctctctttctacatttgtataaataaacccaaagacctcttctcatttgtcccacattcaaacatcatcaacttatcgatcttctccaacaagaatcatcaaagcccaaagaaacacaacagagaataaaaaaagaa

SEQ ID NO: 4121 - DNA, 811 bp, Arabidopsis thaliana
aatcgtggattgtcgtgaatctgtgatagtattccatcatgtctgctatagcttggtcagttttgaagaaatttcaaacctaaagtcataaactgataaaggactaaattatcctactcaaaacagaaagcccttttgtgcgttattgggcctaatcagaaaagtgattttgaaaaagggcctaatcagaaaagtgattttgaggctttttaaaagtttaaagtaaacaaaagaaaattgaggcttgacttttctttctttttttgacttgttttcttttttcctttttcttataagagaaaactaaaacgtgaaagagcttcaccaacctgaggtcgctgaccacttggaggcattctcagctaccaatccattaacttacaaactccatattcttcacgttttactatggtaggtacctttttttaaccttgttcgtaataacaattttatacgaaaagaatagtattaaacttcaacaaaaacaactatgtatattaactggtcagatatacattgctttgttcccttacatcttcaaagagctaagattaaactatttaccccaaataagactgtaatttcatcaaaatctagtaataataatattcaacagcttacaatataaacataacgcgtgtggtctccataagctacgcactgtcttttcatcggttcgtagaaactagaaactcttcccctcacgatcttgctttctttattttgcttcaaccctagtttatttgaagtctctatataaagttctctgtttcaagttactttctcagcacgagcaaccaaaagtaatcat

SEQ ID NO: 4122 - DNA, 1097 bp, Arabidopsis thaliana
cttctttagtcttctgtttaaagctaaaacagagcagaaaacagagtaagaagtaaataaacttaaaaacaggggaaaaaacagagtaataaaaaaaatggatttgttttgtttttcttcttacactcttttttgtaattggttgcaagtaaatgaaatgtgcaaagactctttcttatatagcaaagtttttactatacttttagttagaagagtttgttaccgaactaagagacattgtagagctaccggtggttagtgctattgttgtgaggtaagtgcgtgactcacttcacggtcaacgggagaggatggttgggttgactgattggtcaaaaagattactactatatgggcttgggtctagactcccagaaaaggcccaatagaattaaacccataatcgctatcaacgtgttcttcgtcgcgtgctttaagcgtgtctccacgtgttcacctctactagttcttctactaaccacattttctttttgtagtttggaaatcaattactaaaaaaacaatttgactggttttcaatttcaaatagacaattgtatgtggatcaataattcttttggaaaactaaattatttatcttgtttgttttttaaaatttggaactcatttttattttaatggtttgtactaaagtatattatcagctgaattcaactacacatactacatgtcaaatttttttaaaaaatcaccatgtttcgaaaaaaaaatcttcttactcatctcacagtattttttttattgtataatcaaagcctaaaattatgtcttttctctattttaagtttttgttttgtttaagaaaaccggatatttaatgctgacgtggatattctgattatgaggatgagaggaaggaaaaaataagagaaatctgcctaggaatttatctccacacttctcttatctcctaatttcttccctccaaatttataataaaaccaaaaaaaaaaaaaaaaaaaaaaatcagaagaaacctgagaagctcacagtaaacacatcttcaaccacaggttcatacttactgaaaaaaacagaggaaaaaaaggagctcccttttctatctctaagggaaa

SEQ ID NO: 4123 - DNA, 74 bp, Arabidopsis thaliana
ttagattatagattataaacaataacggttccattgttaacaacggtttttcgtgtggtatacggtggcagaag

SEQ ID NO: 4124 - DNA, 1254 bp, Arabidopsis thaliana
ttttggatccggagagaagaagagtcagagctccggagaaaaagtttaaaacttgttaattagctggttgagtcgtcgtgctatagcctaagccttgcttggccaccaccaccagatccttttttttttgttccaaaaattcatctgacaaattaaaaatattaaaggaaaataagaataaggttgagttataatattttctcgttggataggatatattaagatttctaccaaaaatcataccctaactaaattttcatccgcggtatatcgcgggaacaatttatactttaaaattaatatatataaaattttgcaatttgtaactatctatgtagctatctataaaatatttttattttatagtttagaattgttattaagtaacgtcctgccaaacccgtcccgccaacccgtcccgtaaaaaaactcatttattttattaatgttgatcttatttatcatatgtttatgaatcatttatttttaaaattatctagtaattaaatgctatcaaatatctctgcggtttgatgattataattgaattgtaatagtcatgcagaaaaacaatatcaataatgataattttgtagtaattaaatgatattaaatattttgaaagttttattttagtaaccaatcgtgtagttaatgtagagagattttagaaaaattgttaaatgtcaaatatttaattcgaagattttttttctaattattaaaaacaaatattaaaatccagtggcaaccattgtaaataagtctcaactacagaatttatttcacaaaatggctgcaaaaatgtatatatagatgtttaaagttaatttaatagccaaattaatatcttctttctatccataaaatcataccctaaggtttactgagtttattaggatgtatcaattaaagcaaaacatcccttctaattaatcattttgagtgactgattaataaggaggacatgttaatatatgtagaagcattaaaacacgatggtcttaaggcattaagctattaagaatttttaaaaagtttatgcatggtctcacactgacgaataaaatacgttatcatctttgatcacgaataaaaaatattaatgaaacgagaatcatgtgtaaagaagaaagttcatactagtttcggctcatgtgagccttgtagaggtttgacttggatgctatatatatgtagacatgagctaggcatttatctcaaaccaaccaaccaatatatcagatggcttcc

SEQ ID NO: 4125 - DNA, 715 bp, Arabidopsis thaliana
gacttcaaaatcttaagtgagttcttgtcaaaatggggaagacgataacaaaataaatgttgtgttccttttgataacaaagaaacaatttgtaaacaaatgacacacagatgtatatgctgtttataggttatgctgtttttaaaaaacacactttggacatctatagacatatgtagttttagaccctttttgagttgtttctccactataaatagtatatgtcttcagcttcttataagttataaaccacagaaagaagtcaactaagaatctaccagaaaaaaaggaatttctttaaataagatgactgtctttctatgaatgaaaacagctttggtcacacataagataggaaactatttctagatagtttcatgccaagtttgtcactaaattggtcaaaatatattggcaagtttaacattttcgcataagataataacatatacttatatttttttaagaactaatttgccaatcaaaagtagcaataaagtgaagaaaaaaagtctaataaagtgtagaaattaatcaaattttaagtcctaaagttggaaaaatggtaaagaagcactcaaaaaaaaaaaaaaaaattgtgtatgtgtgggccgaatttgagaaaccagtgacaccaataaaaacctcatctttcaatctcacacaagtatttgtgcctactcatttcctccaaacgtcaaacatagcagcagcc

SEQ ID NO: 4126 - DNA, 2000 bp, Arabidopsis thaliana
attgtccaaagaaaaccgcacaagtggcatcaaacatatggaacatgaataaatacttcttttttatctatctgttgacgaataaatatttattgagatattagagaaaatagaataataatgaggagaggaaaaaagagagtttaaagacaagatatttacggaatttaatgggacgaaagaaaaataatataaaagggggacctgtctttgtcagtgcaatgaacctttttttctttcgatcaaatctctcccgccacccaactaacacatcttaaaccgtacacgtcaccctctctccttcccattttcttcgtctacgtgtcgaccatccaccggtttttgttttctgctaaacgtgggacctattcacatttttattttattttaaaaaattggacggattctttcatgttctttgggtcgttgcataattatgtccatgagtctatccatcaaaataccttcggaatcatctttttattttatatatatactgcgacaacaataattttatgttttgtactgtcttttctggtcaataaaaaaaactaaaaatttggtcgaatttaatggacttccatgaccaactcttcatttcccttaaggataaattgagaagaaaattatatactggaatttgaaaaagctttatataattgtaacgtatttttataattgcacgacaaatctcttttcttgattttttgtatgaaactacaaagaccaatttttctaacaactaagattcagttattatttttggtcacataaataaatgagacgataacttcataatggttttggttttgagtttgaccaaaaatggttttcaagataaataattagatgaataatgaaacgtaccccttaaataacaattatttagatattttaccggtggtctttcatttttcccgaatataaaacattgaattcttatctaaaggacaaagtattgttcttattctgaaaatgacacaaatttaaaatttttatttaaatctatgaatatctaaatggtatattatgtttggtgttttttagtccaatgattaggaattacgaataatgttttcgtaattcaaactctatttatttagattgaaaactatatgacaaataaaataattgcaaaacaatacaagatttaactcggactacgacacgtcatttaatgaaagtcatctttatgaaaatataaaatccattaaactgatgacctaactaaagttaaaagcaaacatattttattttgtttgacaaacaaaaaagaaatatatttctcccaaagaaaaaaaaaaccaaaaaactttatgtttgttaaaaaaataagaaatgataaaagcattttttttaaaaaaaatgttgaatataggaagtctgaagcaagtgtctttttatgaattaaatagtttaaaatttcaagaacgaaacatctccccttattacaaaaaataaataagccaaaaaaagtatcactttaataatgtaataaaataaagtgatatgtatataagtatacatacataaatagtagattcgaagcaattgttgcattagcctacccatttcctccttctttctctcttctatctgtgaacaaggcacattagaactcttcttttcaacttttttaggtgtatatagatgaatctagaaatagttttatagttggaaattaattgaagagagagagatattactacaccaatcttttcaagaggtcctaacgaattacccacaatccaggaaacccttattgaaattcaattcatttctttctttctgtgtttgtgattttcccgggaaatatttttgggtatatgtctctctgtttttgctttcctttttcataggagtcatgtgtttcttcttgtcttcctagcttcttctaataaagtccttctcttgtgaaaatctctcgaattttcatttttgttccattggagctatcttatagatcacaaccagagaaaaagatcaaatctttaccgtta

SEQ ID NO: 4127 - DNA, 2000 bp, Arabidopsis thaliana
tttttttttgtattgcttaagatatgaattgatcaatattttttctacatatataaatcttccaattcattcatttctatatataccggatgtttgtggtgtttttgttttcctttatttagaaattcctataggatatatatacaaaatttgtttttgtaaaatatcataattatgttcacaccctattgagttaatgatttgtttttgtttttcttatgttaaacgttcatggtatatatgtttaaagtaccaacaaaaagaaagagtcaatgtctatccatgatatatatgcttttattaaacattttgattattttaaccaaaaaaaagtagaacacacacattttctagatctcatcattttaatagttctagttgcaaatgttaaacttcaatatttttcgtatatatatgaatcagcttcttctttctttaattttctcggcgaattagtatattttaatccataagagatgcatgcataaattttattgaattaagtgaagacccaatggtcaaaagaaaaaaaaaatatagatatgcaccgacgaagccgccgcgagtagccgcgtcacagccaggtcagcaaaaagtcgccatccaattaaagaagagaaggatagcaacttctgcaacgtgttctgctgagtctgacttagattcggaatctggttcttacgatttaatgaccatccgattttcaacggctaagattgtttagaaccattagtacaatattgtcacatccgcagagaatccacgcccctaaatgagctttacttccatgtttttcgcatctcctcgtgataacatcgacgatcaattttttttctttcacgttttgttgatatatataaatacgttttcggaaatgttttaaataaatattgttggtcatattctatagtatattcggattaaaatcatttttaatttcactaattatggagagatattcctaaaatgccttagtatttaaagaatgcgagtcaattgcactagatgcatgtttttattttgtttctaacgtggaccttatgtaagcaggtctgaagtttatccacaatttgctgtactaattgataacatttgtatatgtattccaaatatgaaatgtcattaaatgtctcataaaagtgataatacaatactgtatttgggaaaaataaatgagtcatacaacatagtaatcaacaaggtaaaaagtcatataacgccgtccccaaaaacagtctgtcccagctccatcctaattgggtatccacgtcccgatcctgtcacaggacaccagtaagaaaacggaaaccgaaaatttcaagaaaccaatatcgttttcttttcctcaattaaagttataaaaaaaaaaaaatccctgaaaatatcacatggttttttaaaacaattagtgttaaaatcaaaatttactaccttctccaccgttatttacgaatttaccatgttggtatattcttaaaaacttttgtagttcttgtaattactaaattttttttccgtaattttttcgattattatttataactttccaactcaagccaatatttttttagtaaattttaaaggaatgttaatcttctaaagatatgtttgacttaaaaaggagttaaaaatgatgagatagccaaaaaaaagattagagaaatccaaataaataataaggggtaaaagagtcattgcagtcgataattagtctccgtctgacgtaggatacgtcaaaaatatccgatctcattcaaattacgctttctcttctttcccctacaaatactcaattctttcttcttcaattcatcacaacaaatcaaaaactccaagttcttacctttttcccatttacaatcggtaaatttctccgatcacgagatacaaatttcactttctgatatcttggatcttccgatcactttgaattttttggtttgttgattttttttttttttttgttccataaagttcgaattttttatagagaagaaacc

SEQ ID NO: 4128 - DNA, 2000 bp, Arabidopsis thaliana
aattgttttaatattcctgttatgttctttcaagtcattttggtagatagcatcagtttctttgtaaagtgattcagtatgtgtttatggctgttttgtagatatatctgaagcttaaagggcagtgacaatggctggctcggttaacgggaatcatagtgctgtaggacctggtataaattatgagacggtgtctcaagtggatgagttctgtaaagcacttagagggaaaaggccgatccatagtattttgatagctaacaatggaatggcggctgtgaagtttatacgtagtgtcagaacatgggcttatgaaacatttggtacggaaaaagccatattgttggtggggatggcaacccctgaagacatgcggatcaatgcggagcatatcagaatcgctgatcagtttgttgaggttcccggaggaaccaacaataacaattatgctaacgttcagctgattgtggaggtgaatccaacttttgggaactactattatctgaattatcgtgttttactgtacagaacacatgtattaagctcaatttcagcaatgaagttttggtctttggagttatttttcattcatctgaacatctttgtctacaacctgtgtgcagatggctgaagtaacacgcgtggatgcagtttggcctggttggggtcatgcatctgaaaaccccgaattacctgatgccctagatgcaaaaggaatcatatttcttggtcctccagcatcttcaatggcagcactgggagataagattggttcttcgttgattgcacaagctgctgatgtacccactctgccatggagtggttcccatgtaagtaaatttactcttgttaagcttagcttgtgtaccagaggtatatattttcatttttatatactgaattcctatgttttcaggttaaaatacctcctaatagcaacttggtaaccatcccagaggagatctaccggcaagcatgtgtctacacaactgaagaagcgattgctagctgtcaagttgtcggttacccagcaatgatcaaagcatcgtggggtggtggtggtaaaggaatcaggaaggtcagcttctgtagatatgccttttgattgtggactaagccgattactatataagtacttattctggttttaaatttataggttcataatgatgatgaggttagggctctattcaagcaagttcagggtgaggtcccaggctcaccaatattcataatgaaggttgcgtcacaggtatggctgcttaactatatctcttgatcgaagcttagctgagttcttatctggttactttactagagaatttaaagtagtaatgcattgcttttctttacatttcattttttctaattttttttttgtatagagtcggcatctagaggtccagctgctctgtgacaagcatggaaatgtttcagctctgcatagccgtgattgtagcgtccagagaagacatcaaaaggtttgttagtggttgattctggatttttaattgtctggttagtggttatatagaaaaacattctgtccatttattcttatatagttatatacatcaatttttgttctccaactgagttatagtcccttttagcgattgcaaattattgcatgagctcttactttatcgtttgtatcgtagatcatagaggagggtccaattactgtggctccgccagaaactgtcaagaaacttgaacaagcagctagaaggttggctaagagtgttaactatgttggagctgctactgttgagtatctctacagtatggacactggggagtactacttcttagagcttaaccctcgcttacaggttggtttcatactgcagctttttgcgttgaaatatattgaaggtccggacttgaaaattgaatgacttgtttaacttgatgtttgaggtcaggttgagcatcctgtcactgagtggattgccgagataaatcttcctgctgcccaagttgctgtggggatggga

SEQ ID NO: 4129 - DNA, 1524 bp, Arabidopsis thaliana
agatttggggttttgcttttgaatgtttgtgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaa

SEQ ID NO: 4130 - DNA, 2000 bp, Arabidopsis thaliana
ttttttgctaattggttaatatatgttcatttttaaaattttgaatcataaaatatgacggaaaaaattaagatgttttttaaactctatatattatataatgatgttaaaaaattgtaatatttcaaactatttataagtttaaatattaataatgttttataaattctaaatatataaataataatatttaaaaaattaatatttttgtttataaggtaatgacacaataactcttaaagcaaggatttagaagatttaaatctttaattaaatattttcattaataaataattaatgtcagtgacatgacattataaataagttcaaatacaaaatttatttatttaaacaaaaaacgtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaatttaaagtaaaattaattattttggaaaaaagatttaatgctaatggcagtaaattgtaaataagtcgaagtccaggatttatttgctaaaatgtatatatatatatataatacatttatacaattattaatttatgatattgatgggatcatatatttacatagcactttcaaaaaatttattatcttattaatttatcgatttgtgtcactttttatactggtctcaagttcggaccggaaaaatttattaatttatagaagttattaatttataaagtattaatttatagaggttctactgtatatcatagacgtatacgacatagattagagtataaaaaaaatacacatcgtcacctatgatggaaacttaaactacatgcatcactgatcacttgtaaacatcttcgcaaaagacttcacagcaaataaaaggttttgcaacatattcttcataacaaacaattctacttgaaccataattatagtgaattttttcttacatctacaacacatgtacagaaaaacgaaacacactaattaatatgttagataaattcacgtgtacaatatagcaaattgcattttcttggaattccattagttacaaccttcatcgactatcgaacgattcaaattacattagaatttgttctttgtttcatagatttatgtatcaacgagttgtcatttcacgcaaaattttgattaaatagttcatatagtcccatcgaacttgattttcatattctacctatattaattagtgaaaatttgaaaatatctatcttcacaaaatcacaataccttaaaaacctagttgaattctattgactattttttagtaacgtttatttacattacatgcatctagattttatccaaaccaaagtgcaaaaatggcgaaaaatattttaccatctcctgtggtaaaaaaaaaacatttaccatctccagtacaaagtaagtcaataattattgttgaaggacctacgcactactactaggccctagttcaaaaattggtctctcacgcgccatcacgaaacgtgacaccacatctttgccacgtgtccatacagcttccaaacaacagatcgcgcttggcacccacgcgtttctcagtggccaaacgatgtcgtttaactgcagtgtcccacgacaacaaccgcttcttcttcctcatccctcgggtgtcttcgagtgtgttcacagatttacaaagaaacttgtcttcacgttaatcacgccacgtgtctgaacccaatttccaacgtgtctctcacattctcgaattcgactcttttagtggttctcgtcctctctgggcttttagactgggctcgaaccatctccattccaccgataacatcgaaacccgccacgtgtcctccctcctctgtctctcgtctatatatccacgctcttgttcgtcgattcgagatcacacacacaaccaccaaacacaaagcttttcaaaacccagagaaa

SEQ ID NO: 4131 - DNA, 2000 bp, Arabidopsis thaliana
acacttttttatactatgaacatgtgtaaagaggctttttttatattatgaacatgtgtaaaatatcctctcttttttttttactataagcatgtgttaagtggccttttctttttctttgcttgtagccttgtaaataataggaatgcccaagggcaagtcccttgaagagctctccggtgaggctgaggttgagaaatgattacgccataatattttcaaattcttaattggttcgatgaattacatcttctattacgatttactttatttttgcgatgcgtaatgtgatatttcatgttcgtaatggtggatctctacatttatttttttgtgtgacaaaatgtaatcaatcgatatttagtggtcatttatgatatttatttgactgcttatctctactacacagctactatcaaattcctaatctttgttgttattatggttatatttaatttatgcatgtaatacctctcgtataacaacaaaacattcaaaccatttaaaacattaacgtgtacatatcgaagtccagaaaacccgtcatttaaaacaaatacaatcctcacatttatatatatatatggtctgagctggattggttgatattaaatccttatttatgtatatgtaatggcaactaagtccactaaggcatgaattatctgttaaaatgaatttatatgcttatgttctcgcgaatatcctatgtttttcgaatatgcttttttaaaataatgattttgactttgctaaatgataattaatcttcatgactatatgtatcctgattgtcactcctcaaatgtcaactattagagttgaataactcgactgcaaaaaacaaaacaaagaaaacgaggaagatggagaaatttaaaacctttcgacttatattggctctaaaataacttgtagttcagatttacacgaaacaataaataaatgattagagcttgcaactctccttatttaattttagaaatgcattttatattgcgaataatataattgcaaagttggaatcaaacataaatatatataactggtcaacgattacaagtaatgccaacaagattaactacaaactgaattcgtgtctacactacttctttttgattttattttattctttttttgtgtgtgtacaacgtctaaattagctacttctatttatagaaatttacatggaatgcatatctatagtaatgctcatatatcaatctgtctccatatagtaattgagatggttaaacagaaatttttgctaaaacttcgtttcctgcttcaaaataataatcagaatccgtaactatcatacaataaaaaaatcatcccatctcacgtatcctagagagatttattgtataaggtgttcatattctggaaggcgtatcgtccagcttagatgatgttttatacttttcaatataaaatagactgtaaataatattttacttcagaaacaaatggtgttcaaaaatcttaaacatcaactataaacatacggagggagtattgatgactaaaattctaaaatccaaaatgaaattacaaaataaataataactatgaagaaagaggcgatcacgttgcttacatatctttccttttcaaaaagcatttttttattacatttaacgtgcttctctttcttcttctctataaatggccagcataattgttcatttctaatgaccacatatagtctctcctcaactctccagagaagttcttaatttctcctgccaagctgattaaggtaatattactttcctttgtcgtctatatttaatttgtgtatataccatttcaagttgagttttcttgttcataattccaaagatatcaagttttgtttcaaaattttggccattgagaggtcaaatgctctgttccatgatattttttaagtctccaaatgaaaatatttcataagcgagaaataatgacatgaaatcttggattctttgcgttgtatgattatagagctctaggaa

SEQ ID NO: 4132 - DNA, 980 bp, Arabidopsis thaliana
acgtataaaagaggtaaatatgagacaccttagagatagcgagttaagggttcaccatcaccacagatgcgtcttaattttaagtttggctgttgtatgatacgaaattggacaaacattaagctaggaggcatgatggatttaatcatattttagatgggaatgagaggatattaaggtaccaaccctcaaggcatattgtagactggtttggtttggacatgtgaagagttttgaagctgaagtgtttggtcactctagcattagatgttgcaggtgtagttttgtacatacatgtaaatgatgtctctttcttacgcacatttgttgacatagagaagctaatatttgcttaagcatgttgtaagctgtaactttagaatttaacctccactgtaacatattacatatgcaatcaggcaaacgaagattcgatcaaacgggtcattgcaaatccagaagtgtgagaagattgaccattaggaaacttataaagtggttcagtcttttacaaattaaatttcctgtttcaaacaccaatcaaatccaccgaattaccaaagatttcatgtttgcctctatccataatggttggaaaattttcaattttttaagtaatagtttgatattgtggggaaaaaatactattctaaacggtagataggtcttacacgtgagcattccgtaactggacaaggatcaaccaaagagaaagcagggagatccatcacggaacattatctttgtaatcaaaatctgatcgtacacgtgtacactatgatgtccactaacagtccacatctgttgacctgacattctcagacacacgagaggatcttttttctttctaacctctaaaatattttaattttaaaataaaataataaaatccgtatatgtgtctatcgttagcttctacagctcaacgaaacacacagttccgtagcagagttttagttttagcagagttggtgaaatca

SEQ ID NO: 4133 - DNA, 2000 bp, Arabidopsis thaliana
ctctagaaaattcgaataaatcggtttattggtttaaattttgagatatatactggtaactgattaattatgtgaagccggttacacttttattgctctttgtagtcaatatttccaagttaatgttacttgttttcttggagtttcaactctatttatacttataaaacaactattgaaatttctaattaaagcatccaaagatgttaaagtaagataattaatgtcatagtttcacatttcattccatataaataatcaaaagtcttattgttgttcatcaatcaaaagcaaatataaccttcagcatatatttggctatactaaggttctttttactcaatttctcattatgtctataaaaaatatgctttcactcctagcggttctatgcatcatcgtttctgtaaatgcttagatgcctcagtttccggctccatttcctttttcatttctattcgaaccgattcctggtatgtcaggattacctgacataacaaaatgttggtcatccgtgatggatattcctggatgcattgtagaggtttctcaatctattttcactggaaaattcggcaatttaggtccatcttgttgtaaagcattgttggacgctgaagtcaattccatgccgaaaattccattcattctgtttttccctccgatgctaaaggaacaatgctcaagaattgtgggtgcaactcctcctataccaaaatagagttttagcttagttttaaaaatctatgatttttttcttttcaacttatttattgaaattgtagcttactctacatgttatactccaaaaagaaaaaaacgatgatacaataataacatagttgtatttgggttcaatacttactcatttttcaattataatgaataacaccttgaaacattaactccgtaattaatttagtcttgcaatttttcataaattgtttatatatgtcgtaacacaaaatttgcgaacggttaataactttactagataaaacctctctaaataggtagatgtgaaaaataaataaatttttgttttaataaatttttcaaatgataatctatatatattttatttaatatatattttctaaaaccaaatttcaatcttaccttttctaaaaccatattgttaaaaactaaagaaaaagttggaccaagcaaagcctctcggtaaatgtggtaaataaatagaacgatataactgagaagaagaaaataaaacaaaattaagaaaataaaaagataaacatatttaagttacaatatttaaaaatattaaaacacttctttttaagaacaaaatggggaattttatttatgttttgaatagatcaacaattattaatagaatgagtttagtttaatatattaaatataaaaaattgaatatataaacaattgttttatgtatatattttttttttgatagggttaaggatttttttctatttttgtttttaaatgtaataaaatttgaaacacatgtaaatatcgtattagtaaataccgaccaaaaaaaatattgtattagtaaatttgacacatatcgcaatttttgtgagctaacaattttaaaaatcaaataagatgacgaacaaagctctggtttaaactttctcccatcaattttttcattaaaccaaatttaaccaattatttggcctaataactgcgtctacgttattaagaataagaacttattttgtgtttcagtagaaaacacactcgttcacaaaatgcctagtaagagtaaaggacgatcaccgccaccaagtgtgtttctcggataaacacatggaatccagccattacttaaacgacacgtgtacgctcatgatttattaatgcacacgtaatcgatcctctgacaaaaaccataacgaatacagaaaacacacgaatacacttccctgcgctataaataagctagcacgaaaaaatttaacagatagagacaagacaagcaaagcaacactttcactaatcctcta

SEQ ID NO: 4134 - DNA, 576 bp, Arabidopsis thaliana
atttttggttggagataagaacgaatgaaacatcgagagatatcgaagagcattttttgtttcaacttttgtagtgttttggaggagaagaagaagagtcaatcttttctcacatttagttgctagatttaatctcatactcgtgttcgtgtattatatctgtgtaatgccacagtttcagaagctatgttatcctttcgaaattcgaaccttctttgtgtaagtagacagagggtttaactaatctctctttctccttacactttgtatgttgaaatatagtatcacaaacattctttagtggttatctctgagtaaacgaaagtatcgggccaaatttgatcttttacatgatttgaggggtatatccaaaattaaccttagttaaaaatgaaaaaacaaatgtttgggccaaatctcgaaatgttacactacttggggtttaaacataatataatgtttcgtgagtttaacacgaccacgttttgtttgcaagttaggttttgttatgcctctctcagctaaacccttcttcttcttccaccgtctccgccacgaaccagagaaagctcaaca

SEQ ID NO: 4135 - DNA, 2000 bp, Arabidopsis thaliana
acttaattacccttagtttttagtcggtgaagtttagagatcttgtggtaatttggtctttgcattcaaaacgctgaatcataaaaacaaaatattatgctgttaatttgactcaaattttctttgttataaagtataatctttattattattttgttcaaaagctgaagcattttttagacaaagaaagtcataacttagtagatattcaatatttaaaaaatgacattatttcctagattttgtagttaatacatttctatagagttatatattatgaatttatataaagtttttttttaacacaatgaatattatatatatatataagttttatgtatttaagtttccttttgaaggaaatgaacatacacattgtaaccgacttaaattaaattacgaaaaggtcacgtgatgtggcatgcatggatgtatatagtcaaaaagactgattaagagactgaattcatgcgaacacgtgcccaatacaaaacaaacggttagacgaacggatactcccaaagtgtttctgttcatcgaacgaaacgtatgttgctcttgttgttgttgtgtagtagtagcgaactacccggttcggtatttttttttcttctttcaaaaatattctcaacgatttcatgttttttgttttgttttattcatgttcttggtcaaacattattgatttggtttcgataaacctattcttgaggattttattatatacctttgatcaaaatacaaatgggtgactttttctttacttcatttgcttcttttttggggtgttagaaaaaaacacttaaaaaaaaaaaaataggagtgataaaacagagtttgaccatagtgtttgcgtcattgtgagtgaaaatgaatgtggtaaagtaaaaaagatttgactactagttgggagtcaattactccagaaaaagcaagtagatgaagaatcttacctccttatctcttgtatacgtgcttgtggtatttgccccaagggggggagctacaatacctctcgcattctccttttgtacaattataaaaagtgaactgtctttccaaaaaaggaaattattattatattctctcaatgtgaaaattacaatagtttatccgacttgatttcacatattttaggttttaattgttaagtttagaataataacaataatgataaatttttgaaaaagaataactaaaaataataattgatgaaattcatttagtttattcattaatttaaatcagctataagtctttttgttaaattgctaatttttatgtgttttacatgtttgtgcttttccaatatctttttgtttgaaaactttaaaagtcaataaattactcaattttctaaaaacgacaaattaaatttgtcggatgcgttaattccaacgtgtaagtactttttgatttatagataacggaattaccattatatagatcacaaagacataaaaacaaaagtacaatgtttaatccagaattttctcgttgacgaagcgtgtattcattgattatgggatctaaattgtcgtgtgtgtttataatttttttaataattaaaattattataaagtcaatttacattgttaatatgcaaatatatcaatcaaaatacacacataaatatgtggatttaaattcggatattatagtgttcaaattttttaaaaatatggaatatcgatggtcaagttatttatatatttgacccgtaaaatgtacagtaattaatttaaacgcagagagacaataaaaattaaataaaaaaaagttttgcaggtttatgtttaatttataaattgaccatcccagtaatcatttacatgatatctctctgattcttcgatttctctttctctctctctcgctctatccttctcctatctctaatctcttgtcttctctctctttctctatcgggaaaccaagcggctcttctttggatcaaaggcgaagtcaaggcggagaaagaaaagagagggtcgtgagat

SEQ ID NO: 4136 - DNA, 1887 bp, Arabidopsis thaliana
cttctctctctctctctctctactccacttgtaaattcactctctttctttctctgttgtgtgtttgaagaacctttgtagtaggagacatggagcttttgttgtttgttgtaactctactagactactactgttgttttctaatcagatctaatggatttgggcctccagctaaattttgagtttcccgtgaatccatatttcaaggttttatctatttgggcctcaacagcttaagcttatataagacgagccgattcgatcatggtttagtgacaactgacaagtgtacttgctaagaaccaagtaaccgaatgagatttggatttttagaaatgatttttcagttttactttggttcaaaccgaaaaagtaagccccgatcgcattcaattatccaaacacgataatcttgctcaattctactcttttaactttggtcctgtctgtttaaaagctaaagaagattggtccctaccaaaaaaaaaaaaaaagcttagaggatttgttttttgatttttttgctaaattttgcttagaggattggctgggactttaagataaagaaagaagaaaaaattacagttacagtttaatcaatcgacttaaatcatataaacttaatttcaatagataagtttgtattagtttagcttgaaaaatagaagtagtaaagagttcgatattatctagaaaactacaacgtaggaacaacacataaacatgtgaattgtgcatgcataaccccaaagagtggcaatatcaattatcaaatatgcaacacttgtaccattacatgtcattctatctttcatatttttgatgattttgcactttgaactctgaaccatccatgatccattcccttgacttgtaaaggttatcaatcaaacttaagtttttaaaaattaaatttgtagtcaagaatagtagtcatatatatatatatatatatacaaaaaacaaaaatttccccgacccaagtgaccgaaaataacgactacatgttttattcctcctttagtataatgcgacattacagtttggtatcagtagttttgtatccttctcacaatcacgattgttggtgtaataaactttattctttctatccaacatgttatagtttccacatttgtgggtgctgaaatttcgaccaatgtcactcgtagactcgtatacctaatcgagtttacttttatatcaacaactacagaccaagattcccatttcacgttgttgtttttttttgttttttttataaacatttttgttgttatcgctaaatcattagtagctagaatgccccgtacacggtcttgaaaaggagtcaaatatgtttttaccaaagaagaaatgtaagaaacataacatttaacaaaattttaaaatatattgactaacaatttgacccaaaaaaaactatcaaatttaataaaatacttttatgattatcatagtttttttccttttcaacaactttataatactgtagtggctcaaagaaaccaggtcggagaaattgttcacaaacgagataatatacaaattcaaaatatttcgatgaaacatttttgtcaaagttgatgaatagttttgcagcacataaaatacaagataattcgtctgatatttaggaaaataatattatcgtatgtgaaaataacaatatagacaaaccaatatttgtagattagaacttcacataaactacgaaccaaaggattttagtagcttcacatcaaagaataaaaatctaagtttcacaaagaaacaattaaatgatttttgattttgaaaatttaataaatagccccacacaacacactcatcttccttcacagccttaaacgtggagccaaagaaagtaaaaacaaaaggagagca

SEQ ID NO: 4137 - DNA, 2000 bp, Arabidopsis thaliana
gtgagccataaatgagttggttgttcgttttaatttctctttgtctgaaaagtccacacgaaagttaagattaccagatcccccacactcttttggttttgcttttgaacatattctcgatcgaagtgaaaaaatttcttcggcacatgacactgaagtaccgtcgaaacatgccaacgggcaacgaccgtccatcattattagtagtttgattttgatataattaattgatattttaaaattaagatatcggaaaagaaaaataaatattcaaagaataaagtaaaataattatcatttttaataactttcttacttctaaaacttactctcattataatcctcctatatttaatacacaaattatgttgttatgccatattttgttttcagattaaaatgtttttattgaaaatcttctaattactatatattgttataatgtatctacgttgtaatgtgaatctaagctttttaaaatttgaaaacattaatttttgtacaaaaataaaataagtattactccctatgtttctatatatatgatgtttgggttaaacgcaactatcatttaatactgtagttttaaaaattcaaccaatcacaaaagagatggtataatctaaaaagtcataaaatcaatacatttaaaatttgtattgaaacttgtaaaatagcttatataatgaaacaaaataaaaacactataacatcctatataatgaaacagagaaagtattattaatagctatctaccgcgtttaactatcacactaagcttgatcgatagattgagtcagagtggtactaaaatcctaattatatatattggatgcatgagaagtttctttaaagatgtaatctatttcaaataattatttggaatatggccaattttgttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacctcagctcctttctactaaaacccttttactataaattctacgtacacgtaccacttcttctcctcaaattcatcaaacccatttctattccaactcccaaaa

SEQ ID NO: 4138 - DNA, 1633 bp, Arabidopsis thaliana
tatcttaaggctttattaacatgatgaaccattgtttcattctccttacggcttactatagtaaaagaaccaatcattcaaatctcttattcgtcaaaagtattgaattattgattcgggaatacaattatggatcgaatataattaagtaaacatgtttaaaaagctaaatttgatcttattatattatcagggtaagaataagatgcttgtagaactcttaattaggtgtagtaaacttcaacaatcaaagtgtttatactaatgatcttgtatagatattatgctatatacatgtttctctactggaggatgaatatgcgagagaaatttagtggaaaacaacttgtgaagaggtgttgtgtgttctaagaagaaaccgtgtggaaatgtatcaaaagtctcgcatcatatcactttctcctttccttgttttcttctgatttttgcttccaaacatttctctctagttaccgtacaaccgcgtcctcaattctcatctttccgagaaacacacacacacacctcttcttgtctctcatatgtacgttactgcgaggatgatatgatatatgacagaagttacaaagattatacagaaaatctattaaaaagagagcaagaacgtacaacaaattgacattgattaatttacaaggtatatcgtaaggtacatgccactatttatgtgttgtttagaagttgacatgaattaagatatatatatatatatatatatatatatatatatatggtatccaaacagtcgtatttcaatcggtgatcatatggagataataaacataacaacacatataaagttgtaggtagtttcgttagtcttaatttgtccagataatattgcgttctataccctagtttggtcttttgttggagagtgtatgatgtatttatcacaagatggtcccagccaaaacattccaaaaatgcctccgaaaaaaacagcaacacataaaacaccaagtggggatttgatctagtgggggaatctcttatccttccaaaaaaatgaggttatagagacacctagttcgatttttgatgagttattaaattattcgttgataaacttaacgaataatatcgactatccaaccaagaatattctagatgcatcaagactgtgtatggataagtcagcaaatacattcatttgctctatccatatagaagatttaagttcacaaaaaaaaaatctagaagacggcttaaaaatgcatgaaccgacgtcaaaaaaaaaatatgcacgaaccagattttaataacttcgacgaccaatgagaaagataataagttgttctagtagtcttcaaatattgtattttgtggaggaaagcaccaagaacattccttttcgtaacacttgactttttcatttttctgagtctcctaagtgttacgcgtgacgcggtgacgctaataatcatatttccttacactttagcttacttacgcagcaagcacaatgggtattttcgtcaattaatattaactaaactagattctagtatataaataggagtactcatcacacaacacacacaaactaaaaaaccgatcatagaaaggaaaaaaaaaatcaaaaccctagaagtcactaagtcgattcaaa

SEQ ID NO: 4139 - DNA, 2000 bp, Arabidopsis thaliana
gcatataaaaccactgctgttaggtgcaatgcatcctccatattcaaaatctacgaataatgaaaatttctcgattttttattttgctggcaccacccaacttgctttactatttcattaaattcggcaaatgctctatttattttcattaatattacatcttgtatttaatattgtgttactgaaatacgtttgccgtttttaaagagttcgtataaaccattaggctatcaactttgtgtttttagtgtgataaataatgtttttgcaggaagtgaaatttgctagttaaaatattattcaaaattatcaaattaaacataatttacctatactgtttattgactttattcccttttttttttccttttttctgttggtttagtttatcaattgttcctgctatctaatatgagaatttcttctattttactacataattcaattattttggttgaagaaaatgatagataatagccaattcttttctgttagttaaaaaagaagtcttttaaaattttattttgtttaatgtaagtttgtgattttctcaaggaggagaaatgtagacaaaggacctcattgggactccaacaaaacaatgtacaacaggaaagtacatcagcctccggtccccgtcaacttacctataacatctaaaaagcattgggatgttcatgcatctaccttttctctttgcttgcagtaaaaaacatttcttaagcctctattcttctagaagtttcagtactactaataataatcatgtacctagattatttttatttttttgttaagaaactagattaaattcctattacagtttactttttacaatggaatctaacaacaacaccaacaccaacagagtctcattagctactgaaactaacataatggattacattgtcgattctaaaaagtaaggttaaaatatattacgtaaactaaattttcttttgctattagtacgtagtgtggtatatcattgatgataaattgcaaaattagtttgtatttcgttttagacagaagtaatagtaacaattatggttgaagccaacaaacacgaaagagagtaaaaaactaaaaacaaggctggagagtgaaattagttgattacttgaatcaagacatatagacataaatcacagctgtgacctgaaaccggcactttggaattaccctttttgcacatttcttgactatgcatttatatccttctaatgcaaaatctaactccctacttgattagtcttaagttttctcaagtggggttctattatttatttattattgtaacttggcccttttgttactttggacagggtctatcatcgacaaaagaaaaaaaaagtaatattaccactaatcaaaacataaagaaatattacattttttgtcaacataatcataaatacctaaaccactaaatacaattcaactaaataatttggtaaataatctggatgagaaagaaaaaaatgttacaaagatatattttttggattttccttaaaaatttttttttttttttttctagctaagaaaaattaaaattttgttgggttgtcaaaaatatacaagctatacatacacgtatacacaaatatagagatagacatttcaactttcccaattgccagtatatataacaaaagccagagacaaagggagaaggatctaagacatttatcaaaaacaaaaagagttgataaactacagtaatggaaaatgagggttcatgatcaacggctgagatttgatgtcacacccaagccgatgggtttgaacggaagttctttgatcacggcaagatccgtcgcacttcttctctttctctctctgcttcttctgattctgccaccgttcctgccgccgcttccaccgcctccggcgacactcctcctccttcctctactcctcatgattctcctcattttcttggctttttctccttctaatgagcccagcctcgccgttgaacctctcgacccctg

SEQ ID NO: 4140 - DNA, 1288 bp, Arabidopsis thaliana
aagtttttatcattttgaattattgctttttcaaattagttccattctttagaaaaaggatataaaaaacatctgtgtatattatttctatgtagaaatgaaaatcattaattagtggtgtataatgtattttaatcaattatataccaagatgattatatgaagttctaaagtttaccaatactattttgatgaaattcttattttattatatagttgaaaatctataaagcattattcgtggatgaatatagccatgaaatgggtattataaactgaatagaacattgtatattatatattatctttttataatatcttttttggacctctaataatagaacttttgcattctgtttatgtgataacgacattgcccaaccttatccctaaagtcagacatttttgagtaaaccaatttgatgccgtgttgctcttccttctcttatttgtttaatcaacattctttctctttgatcattgaagcaaagttaattacccaaatcataggcaactcttatgacatggctataaaattaaaatatatctaaaacccatcaaataaggccgattcaaaataagcccactaaaaataaggcccattaatatactattccaaaagaagtaactaaaaaccctacctgtgaaaaggaagtttaaaggagtagtaagagtaaccttataaataagccgctccattatttttgtttgtttgaaacaaactctaaaaccctaaattcttcttctcaagcagccacatcttcctctttcactagctatggagttttggggtatgtctctctcaaaatcatatctttattaagttctactgaatacctcaatgactcctattgactgttttcgccattaaagttaatcattttggtattcctaagttcgttctgtgattaaaaatctggtctttatacaaaagcttgcctttcttctgtattgaattctctctattactcaatacgcattttcttgtgttcaaaactatacaattgtttgggaatattagcattcttagtgtttaggtttcaatgcatctatctttgtgaggttatgtttcaaagtatctatctttaagagtttatgtttcaaagcatctatctttgtgagtttaggtgtcaaagtatctatatctttgtgagtttaggtgtcaaagcatctatctttgtgagattttgtatgaatttgtactcaaatgtgtgatgaataatgttcaattttaggtatcgagattaagccagggaagccatttaaggtgatacaaaaagatggattc

SEQ ID NO: 4141 - DNA, 1585 bp, Arabidopsis thaliana
tttaaagagaagaaaagagacaaaacttcatcttttttctcattgaacagcttgatgatgttgaaatgagttaaaagattggcttcgaatcagcttttggatttcgttaaggagagaatgtaaattgttgtaagaattttgttaatattgtgtttactagtttgatcttttccttcaaaaatcatatgaaattatcttctttaatgtgtaagtaagtatctttcatgttcatgtaatatctgcatatattaactactgtacagtgtatatgatctttctttcatgttcctagagcttcgatttcttgaaaatttaaaatacttagtaattttttactgctggaagcagaatgagaaagagaaagatatacagtatatatattttttaattacggcaaaggtgattataatgggccgaattgcgaacatttgggcccagtaacccgacccgaccggagatgatctttaatttcgtttcaggtgagaaaatggtttactcaggagcaactatcaatcgaatcagacattgacgaggagctttggtcgtaatccgaggaagagattaaaatcggaaagtgcgaaaatgccggtcatggagaaattgaggatgttcgtggcgcaggaaccagttgtggctgcttcttgcttaatcggcggtgttggtatgaaccctaatctcaatcttaattcctcaccgatcgatcgcattctctttcttagaaaaggatttgctttgggatttatctagtttctggaattcctctttgaatctatagagctagtttgctcgattgtaatttgagaatatagagaaatgcctgatccaaatctctctattcggaatcgtcatttctttgggttgtcaaagagagtgtattttaaggagttgaaattaagcttaatttggaaccatgtcttccattatctccatgtataagtagcaaaagattatgtctttcttgaacattagcaaaaggcaattgtgttaatatacatttgctgatggattctcttcatcttgtaggactatttttgcctgcggttgtgaggcctattctagactctctcgaggcttccaaacaagttaaagctcctccacttaccgatgtatgtattagaatatatttatctctgtggaaattccttttgctgctaaaatcgtcatctatttcctatctaatgaaatgtctctgatgtgggaactctgcatgatagttgttcttagtatccgtgtaggcgaatgtttggacgtttcttttttttgctatgtgatgtagcctatacatcatctcgatgttttgttcctcctgcgtcttcttgtgatttgagagttccatctttggttcatccatgccttaaaaatctatgcttttcatcattggacgagtgtcatgatcacattttgttactgccaaaaatggattgggcataaaagagactagttagttatcacattgcttagttatccaacgctttcctatatactctttacaggcaaacaaaggcgtcaagtattaactcagatccaatttgcttttgcaggtgattgctggtgtcacagggaagaaacagagttaaaacaagca

SEQ ID NO: 4142 - DNA, 2000 bp, Arabidopsis thaliana
catcaaaataaaaacgcgtgaactttaaaaaccaactcagaatatgacaatgaaagagttaacacaatcaatctaatgggagcctgaccattggattgggagaagctatagtgattgatgagctttgtaagagctacgattcgtcacatggtttctttttggccattgtgaacgttttaaaattgtatttcactaatcgtacttctaggtacataaaagtgtatacaactagggaaactcattaagctatacaatccaaaagtctgagctagtgataaatggaaggacggtctaattaatgtgattcatgtttggatgatttgaagtcatgaaagctcataaaaagctttagaatggggtcataccaattcaataaggacggtggatgaagtctttttgacatttttgttggtccacttaattatattatattgatgaattcgttatatgagagtgatactttacaactacaatgaatttcctagaatattcattcggtaaagttattaaaaattcgaatatataggccaaaaaacaaatttgagaggttaaaaatactaagaaaatgttaatggttgtggacatgacgaaaatgtggctcttgatctgaaattcaaaatctttgtagtaaaaattgaatatgtcgcttgtttggttaataaacttcaaatgcttatttttgtttttctaaaaaatctacaaaaattggatgctgttaaaatgataaatctaaatgcaatctcaatgtagaaaacatattgtctaatactacacaaacttgcggtccaaatggtaaaaccatatactatacttttaaactaccagattaaaagcaattacatatttaaacgtgtttaaatcactttacgaaatacatttttctctatggtaagagaaaacaaaagaaatgttttctttcaccaaagtcaacgaccgaacttgctcgagactttcctttcttcatctagaaactaactaaactaaattgtgaaacaacccaaaaagctaaactaaaataaattcacattatctgtaaaaaactaaaaacacttcatattgtcactaaatcttactacacatctttagtgatgcaattttcataacattgaagtttggatcatcttaaatcttaaatatatgaaacgttatcatcccttagactaaggttcatgagtttctaattggactagtctatatatgcaccaactctatagtttattaatgaaaatataatgaacattatattttgttttaatatgaagactctcttttgtttccattagagtttggcaatggattttaaataagatgattcctttttgttttatttcatttatcacttaccttgatctacttcaacttgtttcgtgacttttaggtgcatgaccccaagtattcacacacacacacacgtattcataagcttcttagaacacctccagtggtgtttcttaaagcattcttgaatattcatgacaaaagtacaaggtattataaaatattaataaaatataatatgtgcccctagaaaccattgacccaccatgcattctgaataaacaccgaaccttaccacatttctgagcaatttttccacagaagaccaattcctaatcatgtttaataattaattaatttggattttggagctatctttactctttctttgcctataaattaaactccatctctcttcttatccttctacttttctttcctcttctcagcaaaaaaacatttttagtaacatttgttctaataagaaatttgtctcttgctttaacaagaagcaagactagccttatctgtacctttctttctgaattaaagaaccctttaagattcatatgattttcttaattcttttttatatatgtagatttgtttcttaaacactatatttatgttttacaataattgttttatatgttttcaacttctttgtagatttgcttcttacacacactaatgttttatctttgcagagaaacttgacattt

SEQ ID NO: 4143 - DNA, 885 bp, Arabidopsis thaliana
tgaatccgacggccaataactgtgtgggggtttacagttttatgtgatcgtacaaaataagtttatgtataagaaagacggattatattgaaaatatatagagaagactttaagaggaagaaaacaggtgagaaggagagtaatggtactactactaccaactatataattcctccacaaaaaacacatgaccatattccaacatcatttcaatagtcttaatgtcttattaacaaaaaaaataatcaaaataaaatcatacattcttttttacacaaaacagaacaaattattagtattttaccggttattttttttgacgaaacaggtatgggaatattttaccggttaataaaaaaggtttatttatttatttgtgtaatttgaataataataaaaaaaaaactatatagtggttttggtatgtgtgcatgaatcactgaatcactgatgatggaggccaatcttttgggaaaatgattgtatgactgattttgttccatctaccaacctaccaatacccattcagagacccatgtgatttaataagctatatgtctttatacttattttatgatcttactttatctctatgcttattagtatgactttattttcttgttcaaataaatatgcttgactgtatatatttatgaagggaataatggagtcaaataatatttccaaaatcagattcaacactttcttattgcagtacttgtttgattttcttggtttctcaatttaccgggaagaaaaaagaatccagcaagttgttctcaacagtcaaagcaggcggttccctctttgttaaagggcttacatttatattgggccttgtagcccaactgtactaggttttttgtggcagactcaacttagacc

SEQ ID NO: 4144 - DNA, 488 bp, Arabidopsis thaliana
ttcctacgtgtaacctatcattatggatgtttgaatctgtattttccctagtttttctacgtacgttaaaaataaaattaataaaatctgtttttcttttctttaatcagcttcttgcatggaacactttaatttcagccttcaaaactagaattacaggtctctttgttcatatcaacgatcccgtgacagcaacaattcaaatatgggcaaaaatattttgtgtttataaaatagtatttttttggaaatttgtagagcgtgtattatcgtccacaaaatttattttagtggtattgtaggatatttgtcaaaaaaaaaaaaagtgcgcagccagcagcccctcatgtttaatgcatacacaaaggttatatcagctagtctagagacgagaagcacgtggaaagaagaaactatcaagttggacttggatgatatatatatatatgcagctgtggatttgaatcgtaaaccaaccaaccaatcag

SEQ ID NO: 4145 - DNA, 792 bp, Arabidopsis thaliana
tatcatacaacaacattgtgtaatcatttagagttttatacattagagttatgtttatattgattgaactaattaactcaaaagatcaataaaactttttatgctagaaggtgttggtccaaattgttcacttgtgtgtctttgccagaaaatacaacattagaatcaatcaaaagcattagttttgttccttctctcgataacaattaacaattaacaagaaacctagtgacttctctttatacacatgtaagaaaaatcacacagagactcttcgttcattagtggtgtgcttcactgaaccaaaacactatagaactctaacttcacaagtgaagagaccgtaaagacccaccccagagaggaagagctaaacggtggcgacctcatccgttaagaaattctatagacactcagatcgcacggtcttagttgatcaaccagggttacagaggtacgagcctatgacagttcaggttaggtcgtgaccagtccaacttatcttcactttagacgatgtgagacaaagaaaagactaaagtcacttaacaaagcctatacgtcgtcgtttccttcctcaacgtactaattgctaatatgtcgtcgtttcttacatcagtgagctaatgaagagagagactgaaacagaggtttcttactttcttctctgtatctctcatattttgcttaaaccctaaaaccctttttggattaggttttctccaaatcttatccgccgtgataaaatctgattgctttttttcttcatgaaagtttgatttgtgaaactcg

SEQ ID NO: 4146 - DNA, 2000 bp, Arabidopsis thaliana
cttgcgataagatccaatgtaaggaggaatgacgtccttcctagggatatttgcagaagaaatccaggttcttcatcagctcaactgtcataaattttggtctcatgggaggagacgaatcacaagttagcaccccatccacaataattatgagtgccaaagctaatttcttccatgcagtcatgtcagtttcaactatcaactgatcttttaaatctcaattgtatggcggaaaacactttaaacccattgatgaattgaagatttctgatttgaaatgtctaaaattaccctagatttcatattaccagataccctaacgaattttgaaataaaagttagagccatacttgtcgtcgccgccgatgacacagtatcttccgaaattcctcgccgacttttcttcttcatctccgtcttttgagttcttctaaaaacagtaaatcgagaaatcaaaaaatcctttaattgttagaccctttaacacgaactcgatcaaaattttcgccacttaaacaacaactcgaactcgaacagagcctcaatcggaattctattaagtttccgccacttaaaatttttgctatttaattttaagttttaaaaacaaaaccgtaaccaaaagaaacaaagcaactgaaagtgaacagtctctgagcagttgttgttgaaaggtattttcgtccagtttagcctaaatggctaaaacatcgaaggcccagcccactctgccaattcctagaataaaaagacaataattatggtgaaaattctttattttgaatttgtcaattctaaccagtaccatatctctattgttttactcattagtcttgttattgttcacaaatttattccttagttaaaaattaaaatatattctacatttattattcttataaatgacaattagtataagtaaatatagcttatcccaaatattctcattttggatatgtaaactttttaatattccttttgtattttattttctgatgaataaatatctttttctcatgtaaaaatatacaacagcagagataagtccaataaattcaagagaagcaaaactgtactatcttattcttaactcttagtattcgagttcgattaccagaaagattgttctcagtttacaagaagaggcgtgtctcctgcaaaactctatacaaaacattaaaacccatggaaaaagacgtataattaaactgaaatatacaaagcataaacaaaatgtcagaaatataataagtaaagaatggcagaactagtatggcatgtatttacttttacatttaggtatttagtttatgtcaccagtattctatctccattatgaatgttcaagctgatatttataaacttcacctcaaccaagtttgtatatgtagtcaagactttgcaggacggatagattatccactagtcgatcttccacaagaaccatgtagagtatggctagctccttataaacttgctatcgtagcatgttaagttggagtaattatatctataattgaactatattgttttacagtcaccataagaattgtaattcctacaaccatttttaattcgctctttctgttttatatatttttgtggttaaagttacttttgctagattttgtttggacatggttattttgcaaatcgagtcatctttaacatttcacccccaaaataaacttaaaagtattaaaagaagtagtcctaaattaataggaaaaggtcattaaaaaacagcaagaactttaattatcagggtgcaacaatttacaaccaatccaacaaccaaccgtacaagggccctcgtgatgacctatttgcacttatccactcgttttgcaaagtagcatttacttgcacgtactctctaccttgtgatctataaatagaggttttgcatgggacactatactcaccagttctttcttccatataaattttgaatacattatatataacaaaaatagtattttaagagatcgtcgcctacg

SEQ ID NO: 4147 - DNA, 2000 bp, Arabidopsis thaliana
atgattgtgattttctaacgataaaagaacagagcaaacaaaatcaacacaattgaaggagagaaaagggaaaaaatcttcataaataaaactagagaagtgatcaatcttaataaatttatatttcactccttgatatcatcaaattttaagataaaaatgaaaaatcttggaatccttgatccaatttgatttttgattcataatcaggatacaagttataaacaaatgatcatcttgaatcataattagacttcacaaataaaatttccaaatcattcataactttgaaaaaaatataaaccatatataatatcctaaatttatagaataacaataaaattattttagccaaaataatcaaaacaaaaaccataattcttcgaaatttaatacgtttttcacttgatgcaaagaaaaatccaaatcaaagtgaagataaatagatgaattttgaaaaatacttacataaaagtccaaacaacataaaaagtgatgagcaaagagggagaagatcacaaatatttaaagaccaaatttagagccagtacatcaattcattaacttattatgttaatatatcttgtcttattttattttctttgtaactaaagcaatttaatgatgaattgtatttcgattatctattttaggaattatattcagttagtatttgctcttattatctcttgattattattttaatttaatttaattaattttagaccatatatgcttgttaacttttaaatagaaatagatttatggctctatttttgttatttttgttatgacatgtgtttgaattaagaatacatataaattgagatgacttttgtatttgcatgtgtaacctaagttatgaaaacaaaatgtaatatcgtcgtaatgtagtttttatatattgaaccgcccacaagtatattcatgatttaactcaacgatttagtcctaaaactggtgggcctactctacaaatggctacattaggatttgggaaatattatattaactcttataatcaaaaactttaggttacatatagttacatagtaaaagagtttcctattgtatacgatcaagtagtatatattgttttgtcttttaatcgtgatagagaagtacatatatgtctcgtcacaattatatgtattttttaaaaactagtcgttatatgtgttaagtatgaaatagatgacataaaatgaattagtatcctttggaatcatgaagtttctatattaagtatattgatggacgtcaacaattaccagatcctaataagtgcacatcatgtatatctaacatttcatccctatgttaagattagagatatgcacctcgtatccattgataattaatgattgtttgtgatgtcaatttttagtaaatgtgtgtacgtctattaccagatgcatgtaggtcgaattgcaacatagagtagcacatttttttcttgcattgttccttaaataaaataagcaaaatacctttgaaataaaatcattttgcaggcttaataggtggctacatgattagcagtatatgaactcgttggatgatacaatgtttatgtttttgaaataaaagcattcaaaccaatctcatacaataatagatagttccatatccagcataccatctccctgaggtgttcgtggtgctccctcccaagacacttgtttttagagtttttttttttttctctttcagaaaaccaagacatattctttatgagaatttccctagctcatacactccatcaaagtcattcttctctttcaaacatacttaagatccctctaggcacaactcttgtgtatcctttttcgtaggataaacttcacataattaacaaaacccaacattttcttgtgtaaaaaaaaatacgaagaatgttacatatgttgtaatagtaacgcctcccaaaagaaacaccttatgggaaacccacatgatacatatgttatacatgctcagtctcattcatatatgttaag

SEQ ID NO: 4148 - DNA, 2000 bp, Arabidopsis thaliana
aatttccattgtaatattgaataatcggtgtgttgtagagagacaaattattctcctggttatattaaataataagaataaaacgacgtttagatgattcattacttttaatataatcttcacaatttaacactcaagtcgacaacgatattatcatcagactaatcatatgtttaagtcacatctacctgaacctgaccttctagatgaaatcataaaccagtaataaaattaccaaaaaaaacggtgctttgtcactaattgctttttattgaagcacaaaaccatgaagaaacagaaaaaagtacatcgtctcgatgtgacatttcctctacctcgctgatttttctgttacactgaaagcatattttaggaatcaaatcaattaaatagataatttaatacgatgacaggttccaaacatttcataaataaaaaggaacatataccaaattcacttgaattattatgcactgtccacgatatatatagacaaatttaggagttttatatcagatgccaattgcataatttgcagcatatatattttttaactaaattaaagatttaatccgtattgaaacgatatcgtatccctttaaagatcctttcttatttattatagatccaacaactttatgaataaaaaaatacgtgttttatgagtgtttaatgtttgtgatatatcgttatttatgttcttctgcatttatgatccaacaactttatgaataaaactttgcatttttattatttattatttttgaaaaatgttaggaaattagagtgttaaatttctatggactaagtcgacattgttagagacatgttaggaaattagagtgttaattttcttatggattaagtcagcatagttagaaacatagagtcagaaataaacatataatttcatttacaaaatttcggctacaaaatttcagttttgtagcagacttgacatgttgtaataaaaaagagtcatatttttcacaataatgtttttctaataatgcttcacgtctctttatcacaatttttatttttataaattttgatatgttgttaaaaaaatatttttggaaagttgtctttatttatttttattttttgtttgatatttatttttttaaagattttataaatatttttcccagcgattttgcggatgatcagaagcgtaatatatgaaaattagaatgaataacaaatttatttgatatatatttttgaaatcttcttcaatgtaggtagagtttttaatgttatgtgaatataatctacaaaagattaattaaataaataatgatatatatatatatatacaacgtatatatatatttaagttgttgaaattgaccaagcgttgatcatgtggtcatgaatgatggttaatgaagataaatgatggtttatgagagatggtcaatgagagataatcggaaggtactccctatcttggaatacaatgttaattagtttagtatgtggatatgatcattaatttgactaaacgatcatgatccaaaattatcaattggtacgttcatgttatagaggcaaggatggtgtggtgtgagtcctcccatcatccttaatcaactagctactcaacgaactgcttaatagcatcccttgagcttctttcgaagcttcgcgtcgttagttgatgcgggacaagaggcacaatatagtccttcagattgtcgactttacgtgtattgtaaccacacctgataccaccctttacataatgtaagaggtttgacttaaacattttaacaatattttgaacattatgctgctcacgtctaatctgatacttgacacattccaagtcgaccaaaagtaataataatgaatgtgtagaaatatacatatttttccaccatatggatccactttcagtattatatagtagtaacgaaactcattaaataagtaactctgtttctatatatatgtaatgcatttcccaaaaaattgaaaaaccatatgagaaa

SEQ ID NO: 4149 - DNA, 2000 bp, Arabidopsis thaliana
tgctaaagtctacttttggttggatctgtggtcggaagatcttgacgtgatcacttctataattgaggattgtgtgttgctgctactctcctctcacgataactcacgtggcctttttcttgtttttctttcttcatattttcacaaaacaaaatagtcagagatcttgagagattttttcagaagcatattgggcccaaatgtggacaatttcatgtggttgaattgttaaatttcagatagattagacaactaatcttgttgacgtgcatgcggtgaggatattaagtcgctatacgtcatatacgtgtatacttaaaatctcgtttgatatttctttcttttgtttttatcttcaacgacaattattgcctcaggcatgtcagcagaaaacgacaccgttcatattcgatctcgttattaatatgtttttgaagcaaaatatcattattagctatggagtttctgcagtagcctaaccggaagtctcaaaaagataacgtttatgccggttataattaaatccgataaggcgataaataagtgaacccgtaaagtctaaaattttcacatatatatgaacaaagaaatagtctatagatctccatgcattcttgtacaaacatatttaattttttattttattttctttatataagagttggtgtatgaaactttacattttgtaaatactaacattacatcataatgtcagaaccaataattctagtggaatgatataatctccactttaaattcttatgtctttatccaaagagatcatgaggaacttgagcaaaggaagagggcaccgtttagtagtataggtgaataacgtggcggacacgaggctggtctcattttcaaataaagagagatagagagaaaatggaaggaaaaaaaagctattggcgatgttgatatttgttcgtcttttagtggagacgaccaagagattttgaaaggtcgtcgaggagttagtttattatcttacaattattatggatttcttctgactaaagttttagtgcaatagttttctgagttattatatatttttcgaaattcatccaaaggctaaaactttgtaaggtattctgagtctattacgctagaaatagacacgcttacgtttttaagtcattttaatctgatatatatatatatatatatatactacaattttataaccaattatctttgtttcagacaatttatataaattcatataaactatcagaaataaagagacaattggctgtaaaattgtattattttgcatctatgaaatttttatttctctttatcaaaattgaagacgagttgaaattctatttcttttttaaaaaaatttatatatgggagtgtcaaaaaataattttcctttgtaagagaatattcgtatttggacgagtcttgatttgtgttttccgttagcgttccacattagttgtaaagagcgagaaagatttaagtgataattaaaaagacaagatatgcattttgaatatactctagatattaatcttaagcatttttcatattggttatattttatggtcgaattttgacatccgaaaaatacatcccttattcttcaatttatattgaatacttaagtttttgatagtaaatatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaa

SEQ ID NO: 4150 - DNA, 2000 bp, Arabidopsis thaliana
ggttttcaagatgaagttaaatttcataaaatagtatatttggtatcacgagattttcgccaatttccggcagaaaactgggtgatgaatattagtctcatctcatattgtataatgtacatgtacgtgctcggtgatgggtgaaatttgtcctctccgtctctggtttttataactagaccgatattaattaaaattatgtgtcctgtataaagttatcgttcttaattatacttgaaatgtgaatattggttcctttctttatcttaatctataactcttaactgtaaagtgaaatttgaataagacttttacaaaaaacataaaatacaattagtgaagtcaatcaaagttggaacgattcagtttgaattcactgttcgaaatgaatctaatcattggtggaaaatgattaaagggataatagtaaggataattatatatcagtggttgactttgacaataaagaaaaagacaagtcaatgatattatgccttcgaagttgtctcttggtggtttcattaaacaagacatcctcattcctcagtcaaaattatatgctctttttttttttacccaccgactatctagtaaacattaaacaagacatcaagcttatctctttacagctttgataaattcgtaacagttttgacaaaaaaaaataaaaaatactagtttcatacggttttcattaattcgtaacagttttgtttttagttaatatttttcaaaatggtaatttctctgcagcacacttttaaagtcgaattcatttacaagttgtgatttagcggtcacacacgtttttccgtcatcagaaaattacacatacacatacatatgcatgccagctgcaagtatatcatataatgttatactgtattactttgtaactcgttaattactttaattaagggaactgaataactaactacagccatcactatacatattctctttgttttgtactttccccatgcagaaacctacttagtctattattgttcaatggttcaatttttttattttatttgtatggttcaaattttccatggcggtgaatactttaatgttttttatccttcaaagaataaatagtagtattatatattggctaatccaaaagagtagagaaacaaatataccattataatagacgatttgatcattttaaaaagtcaactatgcccgttacattttcatcatccctaacgttctgaccaaaactttgtaatctatattatcgccacgtaactcattgatctaatctatgaagcaatatttgaccctaataaaacatcactattgtggtaccaactggtatcggagattttactttttaagccaactgattaatattttgtcacgaataatttgcgtttatatttttcaaaatcacattttagtttttacaaaaaaaaaatcacattttagtgtttcttgaatagatttgatcacttttcttaatgtatcgttcatttttttccaattaatcaactgcaattttggccgatttagctacatgtcgaaaaacactaatcgatttttcttccagagttttaagatgctttacgtttataccattcaccttatattagttttcattttgttttcgaccaaaactattgatccaaattattatagctaggtacgatttgaacaaactttgattctcttaccaatcatctacaacttaaaaccaagatagcttcgctcaaaaagaaaaaaataatgacaacatgtataatacatatatgttcaatggaccgactcatctacactgttattcaaactaattattttataaatgattactaaatcagcttattaaattcccataatttctgcgtcgtgtgccgaagttgctcgttacaattgttattcccacaactttttttgcctatatatacaaaccctttaacatcaaactcaaaacacacaacaaacacaacttctacaagactcaaatagtttctatttaattactaaaaagaaaa

SEQ ID NO: 4151 - DNA, 1046 bp, Arabidopsis thaliana
atactaatcttttgaagagactcttactaaagtaacttttagaattgattcaatctttttagaatagattttttttttttttttttttggatttcgctgaggttttaccattttgttactcagcatattttaacgatgttgcatttgtgtcccatatacgttattgttagtgaaaaatataatgtaagaataatttatataactatcctactagcaaagctaacgcaaattttgaactcgaactttagttaccgtgaatgaaaataacagacttgaactttataatactcgtagtatacgtaatttttgctttttgcagatatgcttgccactaataaagtcataaattttatattttcataaactatagttatacacttttgactaaacaaacaaaatcggtttagcaaaagaaaaagttacttttctgatgaactaggataaggaattcggaactgaattttgctacgttctctctggaccacacacactgaacacccttttaagattttctccttctctttttcaacgtaatttatcttttgatcagaaacgacaaaaaagaagtctaacaatatcaaacaatttttttatagatatttttagatatttttcctgctaattttatctagtgtagacaaacccaaatatacgattattataaaaacacgaaataccaagtggacgactgaggttaatagatctagccgtagaataaagatctgcatgaaaggcggtgagaatctaaacggtgataagaccataacacacggaacatcggtacgctctcgaacgtacaagaatcgacgacacacaaacactccacaattatttgaacactggacaattattgaaccgacgtacgagaatcaatgcgctgagggtaaagacgtaaatgaagaactagttttggagataagagcggagaaagattgcgacacatgtatggtcaatattaatctcatttagcttataaatttgggagcttcctctatcattaattttcattcataaatttttcttcaatttgaattttctcgagaaaa

SEQ ID NO: 4152 - DNA, 1064 bp, Arabidopsis thaliana
ggtgacgtaacaagacttattttccggttgaatttggtttaacctattgagattgtgctaaccgaaaacagaaacggttatgacgccaacgaggcaagaggggtaaaacgagaaagaggggatggcagaaatcgtaattaacaaggaaaataaagggtggtttcacgataagtctgtctatatgacgcgaaagggtttcttaaattcagagagacaattaatcagtttcgtgtgtttggagaagaagaagaacagatcaaatacgaggagagatctctaaagagatttatcgtttcaagtaagtctctttatcaaactcttaatataaacaaatcaaaacatgaacacgtcgtgtcttcgtttcgattctagatacgattttttagttcatgtgaatgaactctgttttattactactagggttgttcaatatttttccgagaattaccagaggaacaaagttagtgattatattgatgcagagtatgaagtaattatatacataaatcatgttttgttctcaagcatctacgttgaaatatatataagaagtttttttttggtgaaaaaatatgtatgagaagttcatctttcataatagtgaaacaactctctttcataccaaaaaaaaaatttgaaaaaaaattagtgaaactctctttgtccgattaggttaggtttggactcagaatcaaaatacgattagcataacaaattttttggcatggcaattattgtctgcaggtaaaatataccaatagaaacatatttttaggagtagttaagattatgattgaagaaatactattacgataagcataaaattttcttttgctgttcttggtttttgtcgttttatagaacattgaatatgtacttttgttttttttcaccagtagatatgtactatacacacataagtaacatgggtagtttatatagagagagatttgatttttcgtatatttcttttgttgaaaataaatatgtgtaaaatttattgtttattaatttgacagatttgttcacgttgagaagtttaatttagattaaacaacaaaaag

SEQ ID NO: 4153 - DNA, 1480 bp, Arabidopsis thaliana
attctctcgagaaaggatagagaagattttgagaaaacgaaggacgactttctttctttttcttccgggaaagaattttgggaacccaccactctcgcaccgttggattcgttatttgtgcactattcctgcagccaattaacttatgacatgtggcaaatacataaacaccaatatatttattgaagcaagcaggcagcattatactgtacaaattacaaaaaaaagtacttgcctatcactcctccttgggactgactatctatctattgggccttcaatgaaaatcagattaaataggtgcaacacaacttgggaactgaagaaccacatggcacaaaacagagtaaaattaaagactacaatcaatcctttttttttgccattcctcccatgattttacttgtctattagacgaacctcagctaaatttgtaattacagtcgaaaatattattaagctctttaacacttttatagcctacccttgtctttgtgcattccagagtaatacgaatcgattcaaatcaagccaataaaataaaaccaagcctaactacactttatttaatgcttaatttttgtccttgccaacattacaactttttagaaaaaccatttgatatgattttttaacttgggccgtgacattactaatgaggcccacaatgtacttactccgacgtgtaattgtctccgataaagacaaggaaccatttggaacctctcacgcgctttagctggaaattacgtggagttgagctactcgcgactctatcctatgtataattgtatatcagttttccgtctccatcaaatatcctagagagccacgaatttttccttctttgttgtaaattatgaatattaggccacataatacggaaagtcttaaagggtttggaccattctcaatcttatgttctagtagcttgatgattttttataaaaacaatatggaaatacttttatctctatccgatttcctatgtcaatatgtgtcacaggattttacacgtctaacttatgttggaaacgctatcatcttttctttttttttttttatagtaaacaattgtatttgttatcatctacaactctaaaaaatacatttcgaaaaataggagagagcgagtaggaaataagaaagtggcaacgcgagagtaggaaccggaaatggtaaaaagattctgaggataaaagagaaagcagagaaacagacaaactttatttggagagatgttaacgtggatcgaatatcctcacgttcacactatcccattggatgtagcacgaggccgccacacgcccctacatctggctttcatatccaccctccacgtggatctcaatccaacggtgaccacacgccttttccctcttatataaacccttcctccttcctctttcttatcatcatcaccatctcttacaacaaatctcaggcggctcaacactatcctcttctacattttccaacg

SEQ ID NO: 4154 - DNA, 755 bp, Arabidopsis thaliana
ctctttaccaaccaactaatccaactcagaaaattttaaaatctcaatcaaaaatccctctaagatagccagagaagagattgtaaacaaggatttgaaatctggtgcagagaggagaaactccccgacaatgaacaccaacgatctaaacgcggcgtttggtaaaagttgagtaaattttgttagggcttagttttagtccatgggctaattagtaagtgatttacggcccacacatgagcccaaatgtttcagacccagccaagtttcttcaaattcacccaatcaacgacgatgtacgtgtgtatgaaaatcattaacacgacgcatcgctttcgaggaggagcattacgtgtcctgttagctacgataatgttagtaccgccacaaagaaaaggatagatattttgctttccagcaccctgtcatgggattgatatgaacacgtacttggtatcgacatgaaagctcaaaaataaattcaatccgattcctttagtgatatcagaagttcattttaaatacgaacacgtatggcgaaacaccacgccgacattttctgctgctgccacgcgtcactttccaaatattgattcattaaactaatagttgatccatatccgaaaccggactataaaactatcttcaatgcgttaacgaatcttcatcgatcaaactcatcaaagtctaatatcacaaagaaagagtttttttaactagcttagctcaaagtgtttgcttaagacaagaagaac

SEQ ID NO: 4155 - DNA, 2000 bp, Arabidopsis thaliana
tgtacaattgtggtaggtcgtagatctaaaaatagagtttgtagttacgagttgcttcgtttacggtttttgacttttacctctctctttttttttgaaggacttgtcacatatgaggttgtacgaaagtctaaggttgtggtttttataaaaattagttgtgtatggctttggatcggatcaacctaagaatttgattcgattaaatcatgtcacatgaaatcaagcaatctgaccccaagaaaccctttgtgacctttcatttatcaactccaaagtttgaaaagaagatgagcagttcgtacacatcctccttctagtactacaagaaaataatattataagacgtaataattaatcacaataataataataaaatttgtcacaaaataaacatattacgagtttttgacgatttttgagttgttgcaatacaatcaatcacaaaattttattttgtaacaaaaacgtcacaagagttgcgacaaatatatctaataatcatttcgtcccaaatagttacgacacaaaaaagtaagaaaactgtttaaattacaaactataacatcgcttcaaaatcgtaataattcgtgattaacataacatcttaattacataattatagcctcaagtggtcactagtgataattaaaaatttgtcgcatattcgaaacaattactcaaaactgtggtttttgttactatcataatgtttcagtttatcattcactatgatgaaagtaagtcttaaatggtcacaaattattactaaaaatatttgcatatggtaacaattatcaactaaaaaattaacctcaaaacactattatttattaattattgtcatagtaatacacatttcttatagtcatatacattagctatatatatatatatattataatttatcgccattttttagacgggtagagcacgaattcgtcaattactaatagtggatgcacagattcgacgttaactctcagatggcaacccctatgaagagatttcaggctctctagaaagtaagactcagatctttccaatggtctgtagatcaacttttgattactcttgtagcaaagaggagagaaatccgtggcgatgatgaaggttacaccatcggtaaatacatcataaagccatcttccccaactcacaaattttacattcaacgaaaactataaatcctttagtatatataagtataacatgcttcaattaaaccaacaataatcctgaagtaatatgcataatatttcaaagatcaagtattttatttatggagtatcctttcccacgctatagggacatctctattaattaaacatttacaccagaaaaaacgacatcttattagactaaattattgagaaaaatttaaaacaaaaacgtgaaagagaaagagataaattactgagaaaaattgaagtgtactcaaatgaaaatgtttggtatattaataagaacccttccttcatatgtctccgtctaattggtttatcttttaaagttaaaatttgataaataattatattatactatcttaaccattaatgaaaatgctctaagcactacttcaaggcttaatatttaccatcactactttaatatgctctaatccgtatccgatcgggttttaccggaacccgatccgcttatcccggatggccactcctaattatggtagagtattgaatataaaaattaacaaacaatcagaatgcatgtggtggctaagattttatattctatacacgacaaaatgtataaatcaaattaatcaatgaaaataattttttgtaacgaaatacgaatatggttacatcaatgagataacgccaacatgattacactacagctccccaagtaatttttatattcggtagagaatcttttgacgtatttccatatttaactactaatttttacagtctaaaacagtcattttctaccgctataaaggaatacttctcttcgtctaaagaggagagaaatcc

SEQ ID NO: 4156 - DNA, 597 bp, Arabidopsis thaliana
aaaggcctatggatttgtgtatgtataataatcttttcatctaagaaaaactgagtaaagaaagaaccagagattatggtgagtgagtaagtgtaaaactcaaacttgggctttgtttctttttgcaacccatgtgactgataatgaaggtgtctctcattactactagtctactatgccatttaggacaattattgagactcaatcatatgatcctcttgactcagagaactagaaaaaaaaagattggataaaatttcttccaagagtgattttcattctcacatgttacaacaaagcatgaaccttatcctttaaaaaatatcttcttccttttgttcaaacttttatcttctttgtcatagaaagtttggaccactgattttagtccgttggattatcaattattgacctcaataatatcaaaatttacttcaatgagaataagattacaattttttatttttttttgaacaccaacaaatctgcttcttctctggctataaataaagcataaactgttccaaaaacagaaccaaaaaatatctaaaatcactaaacctatcttcttaaccaaaagatcaatagattacaaaa

SEQ ID NO: 4157 - DNA, 2000 bp, Arabidopsis thaliana
tgatattttattcaaataataaatgaaaaaaaactaaatatttagttaatttttctttgagtggaatctcagtctcaatcacagttcgatatgtgaaatctatcatttcccatcgacctatgtcataaaaactacgcaactaacataaccgagtaaatgtgtaataaatcgaagtattttacacaagatgtagctagtggcaagaacaagatgtgacgagcaagtatctcgaaaagaaagtaggagagacgcatggttccaaacctatttatgcgaatactccctgacatgttaaaaaagtttgtgcggcatgcaaatcaaatccatacatagctcatgcagactgatatatatcacatactttcggtattagcctattaggtatccatgtagataaactctcttatgtaatacacatctgaattctatacccttggtcccttgctatattttcggaaaaatgggtaaaacaaccttgaacttttctaaaaacatgtaaaaaatcttcacatttttttgtggaattttaaactctcacctttttaaagtggtaaaataacacctaatatcaataaaatcaatttaaaaacaaacattatactaatttaaataaataaataatcttgtttaagataatttttctagattctattttacaattgtttttttccaaattaaagttatttagttttagtataaacttaatatataaaaattcttatttcaaatctatttgagacataggaaacagtttcgttatcattaaaatcttttgttatgtaaacaatttaaatttattttcttggacaattggtcatatttaatataatagattcaaactatacccaaatttattttgggtcaagtttaggtttgatttatctgctagatataaatatgtattttgtgttgtatatgatatatttttattaaatttataaaaaaggaaattaacaattaatcaaattttaggtgaacgtgaaaccaaactaattttgtaacatggagcgatatagaaatttttataccaaattgaatataaatatatgtttataatttttttttttgatttgactactcaagtttagaaaaaaattatgtttataatttaagtcattttaaattcataacttgaaaagttagaattcaagttagaacaaattcaaacaaaaaataaacagaatgggctaatctataaatgtttatagtttacgtaataatttttaatggcaatgaaactaattaatttttatagcataaaaatcaaattttagaaagaaaaattgcaaactaaaatttgaaaaagtaaatttcaaactaagtttgtttattgtttatttgttaatattaggtgttattttaccatttttaaaaaagttagggtttaaaacttcaaacaaaaaaatgaggttttttttacatgtatttggaaaagatgagaattttattacccttttttcctatattttctctatttcctaacactcgttacagcaataatccatgctgattgtttataaatatttataatttgtcggaaaatgacagctatggcaaatttcacgttataaaactattttttttttttttttgataattgataatataaacttatagttaaatcattaaagagtaacattagcaaaaaaaggttactagaggataaattaacactaggtactgcattctgattggcagtgtgtctccacatgataaaggagttgggaaaatactaaggatataaaaacaaacaatcaaatttgttaatttcttcataggaaatgggttataaaaattaaaagtgaaaacaatttttttttatttttttacctaagtgatgatttgttatcaataccttttaaaatcatcatattgtagcaggctagcagccagtgctttctatataaagaatcaaatatactctgtgactaattacatcaaacacatcaagcaaagtaacaaattccataaacacaattagctaaaagaaagaaacaatc

SEQ ID NO: 4158 - DNA, 1841 bp, Arabidopsis thaliana
acgttcttcagcagatgatgaaaatgctaagctcttgcttataagtttgtgtcgtgacccacaagatcttcaaattgcctgcaacaaaacattaacaatatgaatgaatttcagaaaggaaaacatagaaaacagagacgatttcagctaaaaccgtagcagcaatcaaaccaacaagaaattgaaatcagcgtaacagaagcatgaaaaagtctgaatcagattatcttctctatttggaaaaagaacatatatgagacaataggacttcaaattcatcggaagaatgaaatccacacgaaccggagactgctccgggaagtaaaaggaaaccgatggagatgaataacttaccagattataatttctagagcacaaattcgagaagagatttgatttcaagggcagagggaatataaatatcggatcaagaaatctggaagcgagagagtcgtcgtgcttcgtcttcttcttgtgctgcttgtttcaacttcgtcagcgtgataaatgcgtagagagcggaagatgcaagaaaaatgaaagtctattttttcttttgcctaaagcaagtttgtctcttttctagtactattttgcttaattaaatacttttaatgtcttaacaactatacgagtatttaattcttccactaatcttttgtccttttcatgatttatattatgtaatcaataatgatgtttttactcacataattttgtagtgaaattagctctaagaaattacaatttttctatttcttttttttttttggaaaaatgaatggacttttcttaaacaacactttttcaaaatgaaataaacattattttggtattatattttttatatatatttttttttgtaattcagaaagcttcgacactgttagatttagaccattctagatacgttaccagttaccacttaccagtagccacataacagtactagttcatatatagcataaatagttaccagattttgatgttttcaaattaaatatgcgactaaaactctaaaatcattcaaagttattattatttatgagtttagttttcttcttttcctttcgtacaagttagatatcatgtataattaaccaactgtccatcataatctcatatattctggatcaaatcgtccgtttaatatagttgaatatgtctctataattattttaaaatgttacttgtgttatttaagtaatacagaattatgtaatagataaaaaattgtttgaccaaaaaaaaaaagagattaaaaacaatgttaacttttcgtccaagtagacaccacataccaagttaccaacaacacttcacatttgatcattttagttgatctcttccatccatgtggtattaatctaaaatatccaatgattatgacatcttattttattttggcaacgatcgagtattaccattaattaaaatcaacatgctattaaataatccaaataggcaaaaacttcacaatcaaaagagaagaagaccattcgtcgaagaaaattactcacaagagtataaaactatatatatgatcagcctattcttaatgtgaacattgagaagtggggaggttaaaatgcaatgattttgatccaaagttattgttgacaaagacaattaaagaaggaaaattcaaaggagagatgagtcaaggacaagtcaacgaccatttcgtcttcgtcttcttctttatactcattagctacacgacgtcgacggttcgtcattcttcctctaagctttatctttctgatctctgaccttgtgtctctgtgcatgtgtgtttatctgctactgtgttttgtcggtttgatctccaaaaaccagac

SEQ ID NO: 4159 - DNA, 1122 bp, Arabidopsis thaliana
gagacaacaatgatactcttcgatcagtagatgttaactatatgtttgtgtaatcttgttataatagtttgtatgaacaataaatgaaacatttgtatgaacaattagtgtttttactaaattctaatgtcaattaattattataaacattttaaatgtagtagtattcaatttcttacaaatcataagaaattggttcataaacctggagttttcatatgaaagaaaagtagataaaagctataatttagtcaaaccatccttcttaataaaaccacaactatgattaaatgtgaacatgtatttcgacacgtaagaagttgtgtaaacagaggaaagtacaacggacatgtgggtctatttgttgcggcacaatataacaaatttctttagtatatttttagtatcgtgaggtggtgagtcttgtaaccatagaaaattcaccgatactttataacattgttggaaggaaaattcagcaaacaagttcgtagatggagaaacggaaaaaccaacgcctattataacaacaacatttttaatatatgccaaaaggaacatcaaataacagattagtactaattctttttttatagctcagactatagagttgtttgttttcttgggcgtcaatataacaaacgagaatgacaaatggttttaaagctgttgatgtttcatacacagacaaaatggatcaattatgaagaaccacgataaagtgatgggtataattggggaagcagaagaaattcttgacgaagcatggggttgtcttcagaaaatgaatggatcaagtcaaggtacacatgctccagggataaggcaaggttaggaattaggacacatctccacttactaaaaaagagataaaaaaaaattataaagggaacgttataaatatgttgtaaagtcaacatctgtttccttctagactcttcgcatttacatcacactgccgaccatataaaacggcaaagttcgtcgtcgttttatcacaagaccatcaacaccataaggctataaatccaagctaaaaggtagtgattaactccacaaaaccagaaaaaactacatttctaacatatagaagaaacagagaaaaagagagagagaccccta

SEQ ID NO: 4160 - DNA, 2000 bp, Arabidopsis thaliana
gcaagagagatcatttggatttttattttattttcttttctttttagtttcaaagatatttttttcagaacacattttgactttcttattttgtctgaaggacgagaagtcgagaacgtctactttttaggagtattgggcctatatgttaaacaaattataagaagcccaacaagtaaacaaaattgaagctgctttctaaaaaaacaaaacaataacagattatgaagacaaacaaatattagattttttaattttgattagaatatactgattaatagaactagaacatgtatcacataacatctacacaatgaataatgcatacaagtttttaaaaagtcttgcaacttaacactctcaagatcccacatgtcaagttttggattcgatgaaacatatgagtttgttagtaagtttaataattgttgttataaagaaatgtgtatatttatatattacaattaattaaataaattgttttcctcttcattggattgcttcacttatgttaagagtttagtagttgctttcaaggccgaatgatatgtggccacgaacatatcatcacacgtggaatgagaacgagtttcgacttttcaaatatgccataaagcctcaattatcttcttatctcgcttgaatatgcaacaaaaagctattaagatattcataaaatagaggcgtctcaaatctaccaacaaaaagctacaaaagatccagtccaatccactgaagaatcccaaaacagagtagaaacccaaacaacccgattcagcaaataattcaaaaacgaacgtccgtacgattttccaaaaacagaaagatgggttccacaagataatgcgtggggacgtcaaaatcctctaaacccgtggttcggccgcggaaacactgtccctaccttccccaccagccttcactggccccatacgtcactctcaagctttactttctattttccactaaagccaattttgttgttttcttcaccttaccactctttttttccctctttgttgtgtcttcttttctcctaaatgtcaataacgtgagagcgagaggtaacgagagagatatttttgtcagcgaatatatttcatgcatatcttattgtgaagattttttataccttttttttgtcaatacaatatagctattattgagattgagatattttgtgggaattattgggattcaagataacttgctattttgtattggtctaatccttcgcttagtcctgtcctggtccatttacatgtttttggttatagtttgtttaaactgaataattttgttcatcatatgcatttatgactcatttttaaccgtccatcgaaattgataattatccattaccaaatctgattaatttttttaaaaaatcaagcttttctatattgtagtattatttttggttaaatattaggacatctacttccaatacaaatactacatgagtatttaaaatatcatttcacagagatatttatgtctattatgttatagacgggtgacaattaatgacaatttgtttattcataggaatttaaaaacgattgtaacaacagcagccagccaaccacacaggcacacactcgatagaatttaaagaactcataaaggttaacgagtgaagagtcaaaagtctctttacaagggtcaaaggacacacgtcagacagcgagtggaacatcgtgggattgcttcgctatgtactatacacgtgtcattcacagagacaaaaactccgtgtgctccccacatatccgttatctctcctccggccaatataaacaccaattctcactctcactttttatactaactacacacttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatc

SEQ ID NO: 4161 - DNA, 2000 bp, Arabidopsis thaliana
taatagattatttataatttttttaattttaatggcttaaggctaaagtgacgttggatcgatgaagccgccatagttcacaaatggccgaatttaatttgttgtttgtatttaataagtcaaaagagatttccgagaagcaaggtgaacgtaaccttaaactaatcattagaacattaattatataagttgcgtttatcattaatattgttgcttaaaattacaaactttcaaaatcccatggttaagataattagtgtttcagagcctaagacggaacggaacttgtgtaattttgtaagaataaacatattaacttcgtgtctaaaaaaaaacatactacactgacttcgttttctaataagtaattgttgtagaattttaatttatttctgtttatgtaaactgttattttgtatgtttaatgcatatattttagacaagatacttctatccataatagttagcttattaatagaggtataataatctttttagatttcatattatatttagtactattggttttagaaaaatggaaaaaggtcaaataaataataggaacaccactggtttatatttcttttctggattgtgtatactttttagaagaaaactaaaacggcatgttgaaaaggaaaccaagaggatagtaattaggtcagattacttgtttagttacaagaaagtcaagaaatctcataattgagtttaaaactttaaacatttgcatggaagtcaataaatctataatccttactcgtgatcatcttattgtttccgtgtaacgaaattaaacgcgtaaaacatcgcgtaaactatagtacggtatgtgatatgcaaatatatcttaatttattttttattttttatttttcttgggcaatgaattgaagagttgcaaaattatttgccagcttaccacatgcggccacaattttaaccatgattaatcttcttttggaatttagcgagataaatcaagagtaggtttattttagaacatagtatataatacactaatgaaaagtctcgttaaaacgtgtttcacgtaaccgacctctaaagtatggcgtgcgagtaacgacaaatgaaatctcaaatgaaaatggagattattttaatcttaattataacacactaattaacacccgtcaaacatcctgatatgtgaacgtggaatctcgttacacaatcgaataaaattattgcttaatacgatccgtctttctctctctttcgtaatgattatctatcaatattatcttgactaataaaagtatcgcaaggccttggcagtcacatgttaaatgatgatatacgttgttgcatgttaaaacatagtacaacgatcatctaggctgctgctaaattctattttcaaaaatgccttttatatgcaagaaaagcaaaataatcgagtttttttttttgtttcattataaactgcttcatttttcttaggaacggccaaactgttaaaaagtaaaatatgtatggtgattaattgatgtaaccaaagccagttcgcccgtttgattgtcaacccacgttatcattcacttgatcacttccatgaaacatataaaagctgataatacttatattataaaggaaaaaaagtatgaaaatattatcagtagttagatgattagttcacatctaaatgaaatacgacttaaactgaaagagacatgagccaattcgtgtcgagccacaaattttggacgtatatttttagcccgtggttccacaatatttgcaggtctttttattcaatgagtttattttgtcttggttgaataatgaaatttccaaatataaaaaataatagaaatccgaggccctacacaagcacacatagtaactcccacattatatataagcggccaatatcagcaactcagagattccagaaagaaagaaaaaaaagaaacaaataattccaaaaccttctctcttaatcaaaatcaagaaacttacaagatctggtgaaaacc

SEQ ID NO: 4162 - DNA, 2000 bp, Arabidopsis thaliana
gatgatactttgttttttgagaaagaatgaacatgatatttcaactcgatttttcttcttcttatattaaacaagtaaataaatcaccatttgtttctaaagaagcaacatgaatatatatataaattaaagaacgatggacatctatgtcacggtctaacatttttactggcaaagggcatttgcattatttgacctgattgagcatgattaacctttataagataatgtaatctcttaatagccaaaacctacgtttacgcttttacccttcatccgtttttttgttcaactttttactttttgtttcagtcaacacacgtttactcttcatcaaactcaaaccttaaatttgtttattttttagttttattttggtagaacattgaaaaccaaaatttgaagatcaaataaatcaaagttatttatggtagataagtagcttctctcgtcgtttcaagatgcttaaataagtagtatcttctgactttctgattccctcaattaactgaaagaatggttcaaggatttgttagctcttaggatacattatatataagccgtttgaaaaacaactaggtatgttcgaccaagtagtacgaaaaactaactcctaactaaacgagaaaaaaacattaagagaatgagagttccaacatgatttctattattcttgtatgaatgagtttatgagaatttggaataattcatgaatctacccaaattttcattatatatggatttatgaaacttggtaattgatacgaaagtattttgttattttattctcgatatattaacattttttttttttttttaaaaatagtgtttttttttaacatgggagagcacttaacaggacgggttctcgcagaaacgatatatatttaggtcaaatctgttttatcggggttattagattctcttggcccaactgtagtgtcaaatatcaaaccgatgttatcttattaaaaaattatattaacatcaacttaaattgttaaatgatctacatacatgaattttaccccattatttatttttatttgtcgtcttcgattgtccataatttctaatctgtaatgccaaatttgatgatcttcaactcgttaaaaaaaccaaaccatagagattttgtatatccaatttagggaattcattagagttcaagaagtcttcataattaggttgcatctttgaatacctttttctcatttaggcataacaatataataatttgttttttgttttcattttcttttggtgtcatcttcaaaaatctgtaaacccaaaagtttgtataacttgtttattaagatatttttaattaaatttttttttttgacatttttaaaaaattataaagtgttttatgaatttaaggagtaaataatatttatttagaacactataaattagttttacaagttcttagaaatgtatctgtaaatttcaaaaaggaaaaatatagcatttaattttgaagatttttttctacattatatatatgataaaaatattgtattttgtactttgtagttacaaaaagtcattatatcaacaaatctaaatataaaatatttttctatatattactccaaattaactgtcagaataaaaaagaagaataattattacagaatctgaacattaaaatcgtccctccatatgtggtctctgtctagtccaaaagcaatttacacatcccaagccgaaactatattaaataaacatttttttttctttaactaaaacatttataacatttaacaataaaagttaaaaatcgaacacgtataacgtatttttttacgtatacgtcttgttggcatatatgcttaaaaacttcattacatacatatacaagtatgtctatatatatgatattatgcaaacacaaatctgttgactataattagacttcttcatttactctctctctgacttaaaacatttattttatcttcttcttgttctctctttctctttctctcatcact

SEQ ID NO: 4163 - DNA, 1679 bp, Arabidopsis thaliana
aatggtgttctgttttactttttatctccatgtgcagttcacttggtaagtgaggaacatgaggaagaagaagcctctagtggagttagaggtggccaatgcactcatgtcattaacttaaatcttacagtcacattaaaattaagagaatctccaaagaaagaattttgttatgtctctgtatatatatatcatccttagatgttaccacttatccgcatcatatgcgagatcatgtttgatttgtacaaaagaaaacaatgaatttataagaaatatattttgtaaagtagttttgtacaaaagattagtgtgcaaacatttttaacatcaacgtataaaattcaagtacactttatataaactaaattactagggttgaagatgaattggggcttgatggtttggagagacagaatcttcgaagatctatggagaaactcaaagttgattgataatctgcgttcgtcaactgataggtttactcaaccatttgccactcaaattagttatgtcatcatctgatgttaaatccatcagccacacttatcctttttttaatctaatcctcaaacctctccgaaagagacagaaggtcttcaaaccaagagtggttttgtagttgaccactttttgaggcttttaagttaggtttaactacacccagtggaaacttcggttcggacaacaacaagaagttgctcccaatctacgtttaccacgtgtcactttttcagtccacccacgtgcttagccggttacttgatccatttaaatcctcaatttctgtattcgtgtacgtatattataccaagacaaattctacttaataaatatcttactcaatctttttaattaattacaaaaattcctatgcattatttttttctaattaccaaatatagtaataacaatcctgatttgtatgcaaaaaaaaaacatgaagagtccattaaactttagagattttttaattaaagatagtttgtaactgaagttttgttacacaaaaaatatctaatctaaaaagaatgtcgttttcgtaattagaagactttgtaatttgtttttttcctaaaaaacgaaaagaagtaaccaaagcttcttcatcaaccaacgtattttgcttcctttcttcttcttcttcttcctcttcccctaacattccattccccgtatgggtctcaccacttcctaactcttctctctcttatctcttcttgttttagctatgaagaagcaatctcaattcagatccaatcatacccttctcttctttcatctctgatcattaacaacaacaacaacgactcgggttctgtaaattcagttattgggtatgttcgatctcttgttctgtttcttctctttattcatttagcttgttttaactcttaatttttgagttttgattatgattaatcaagagttatcatattaaaaagagaatttttataaccaaagtttgcttttttcttatggagtagtaagattgatagctaagtaaaggaaacgatattaaaaagagaatttttcttagttgaatttcactttttggagacgtaaaggagaaaaaagcttcaatgattcataaatcgaaaattctctataaacccttttccaaaatcttaccaatttaggggaaaaatactgaaagttttggtttttgcagagagaaa

SEQ ID NO: 4164 - DNA, 2000 bp, Arabidopsis thaliana
ctcataatattttaatatctttttataaggataaatattaataatgttttataaagttaaaatatatcaataataatataccattaatgctaatagatctctttaaaaaagaatattagtgtgtagtacattttagatttggaaagatttaaatgattgttgtgatatatttattttaattctaaattttagtaacaaaattgatttatatttggatttgagaagaaatttgttaaaatattaaatgctaatggcattggatggtaaataaatctcaacttgaggatttatttcataaaagtgctgcaaaaatgtatatgtagatgagtaaatagatcaaataactttcagtcaacatatttacaataaaatgattctccaatattgaaaatcacatctgtcattagcatcaataaaatcgaattttattatatagtatacgtaacgagacacacattgagtctaaaatattgaaaatactcactatcacatatgtcaacgataacactaatttttttttttgtataatatacgtaacgagacctgcattagatctaatttttaatcgattagagcttaaatgacatcgttttggtttgactaagagaatcgttaaaaatgttagaaaatctgttaaagcttaataactgtttgtttgttttttttctttctttttttgtcaatcgaaaattagactattaaatgacaattttccgtttaaaatggcaagtcctagatttgaaaaggtcttttgaaatctttttaagagaattaagggtgaattaaatatattcagaaattaaagggtcgaattgcaaactttcttggttcatacttggtctgcctttgtccctttcttatcttcttcgcgcgcttttgaaaaaaatagaaacccgccactgaacgtcagtcttccacgtgtcctctcctgtgctctgtttccgatcgtcggagacatcaatttgcctgcttgtagggtgattcgtcaaatctattatcaggttttaaatatactcgaattgacttccaaattcttagtctctagtgtaatgattttgagaatcacttaactccaaaaatataatccacgatcccgtgttaattattgaagaatcaatcgtttttaatttctcaccaatagatgttgctcttattacttaaaacaaattgtttagacaaatgtagcaagtgtgatacttagtgggatcttaaagacgatttctcctataacagaggacaaacaggtcggtcaattacaatgtcatccctctttaccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattacaattattatatcatctactaaaacctctttctccctctctctttcttgttcttagtgctaaattttctttgttcaggagaaatataatggacctcaagtattcagcatctcattgcaacttatcctcagac

SEQ ID NO: 4165 - DNA, 2000 bp, Arabidopsis thaliana
tacgtacgtataagtttctgtgatttggtgcgatgataatagtttacgtaattataaaccttttaaccatcttggacctcatcaataaaattcagaagacaacaacttcaaaggatatgaatagttgactaactgaaaacgtacgatgaagaaaatgcaaagcaaacaaaagaatgttatcaagagcggtggaaaagaaatgctttaatgatgtgattcaacatcagtacatcaccatactcgtgtacgcaactttaaaagttgtcaaaaaaaacagacatgtgatcaaatatgattcgcaaatgcatcgtacacatgtgacatgaacaattatatgacagaattttgtttttgttagtgacaaattttcttcttttttttttctttctgtagcggtagattccaattagtatgataagaaaccacatacatatatatacacctttttttcacgaccacaagaaaatatattattgtttccttcttctgcctccaacattgatatgctttcaaaattctctaatatgagttgtcttactgtttaggtgacttttgattcaatagaataattttcttttaaatcaatttatgaacacctcacggaaaatcatctaagcgcaatgatgtatgaatgaaacggttgaataattcttgattttatgtttaaaaacatataagcacctcgatcgcagcaagcatgggagtgtgatttgcacgtttcatatattctcctagtccaattctctaagagaaagatatcgatctatgagatgagttctatttattgttcggtgagttttaattgatcaaataaataactttctttgttaattaattaaacaccatgcgactatagtattactccatatacagagatgtatgattagtgaacacgattgtagtatcctcgatttctttttgttatcaatttcttttacaccttgatcacaatctgagtggttgttactacttattagcacgtttcatataaagtaaataattttatcaattaataatacatatatgcttcaagttgagagcaattaacgctgtcaaaacaacacaaacaaacattaacaatgaattttgggaaggtgtctctcatctatgattgattttaagatttgtttttccttctatatttgcaggaaggaatagttctatacaatcatcagctaaacttcaaattctttgtaatcgtagatgttaatagtaaactcgaatattccccaagtcatactaataaacaatgaaaattgaagaaaataaaagtcataaacaatgaagaaataaacaaattgcaatataacaatttcttacaattctcgacttttgcgcctttgagacatggtcaattaatattatgtatagtaatggtagtggacgagtggttgatatgtgaatccgaatttaatcccacatcacgaatttgaatgttttcgaatttctatattaaaaagttttaaaatggttgccaagttgtattggttcgagtatctttattccgagactagcatatggaaaagattaaagaaagaaattctagagtttgagtttagtagctttattggtggagttttgaattagattgatttatatggaaaacgtgaaaacttgcatgtgttcgaatttccatgtgaaaggttaaaaaattgttttcaagctggcatgggttaatatctttaatcttcgacgagcacatagaaacaaatttcagagtttttatttaacttaataatggagttttgagagaaatgataatcataatatggagaactcgaaatcgtagaagatgttttttgtttttttcctctggtcttttaaaacgaaaagcacaactttcaagttccactactaattgtcacgttacagatatgacatcactactttgatttgagtaaaattttctctataaataaaagaacaaacaaaccataagccaaatcctcgcacaagtagaaaaaaacacaaacatcctgaaactagaagagagagacaaa

SEQ ID NO: 4166 - DNA, 1511 bp, Arabidopsis thaliana
ggctaattttagaagattgccttcgataggtgaaactttgggctttgttgtcatgagaatatattagaatcaaaagttgtatatatattctaacatatgccctaatatgctttgcactaaaatcgtttgaatcttctgttccatacttcacgttgacaaatcacaattttttttatgtcttttgtttctttttttttgctgaagccaacaaagttgtccatctctttcttgctcattccaatacacatcaaatatagtgaacataatatttcttccaaacttaatctgaaaagtctagactaattaagattaagattcataaatataacttaatttgcacctatttggatatgagggaggtatctgttaatgtctcaagtcagttataattttgggtcgctaacgcatcgacaatgaaaagaacaggaccaaacatcgataatggaaaagtcatagatagagcttttttggggcggctggatccatacaacataatgcatctcagtgttggttaaagtttcaacacaataaccttcagagtcccgtacaaaaactcattaaaactgattgtatataatgagtatttggacggacgattagggttttatatggtttcaatatttataaaaccgaaaaaccataaaaccgtaaccaaactgaattacatatgtttctatatggttatagttttagtaaaaccaaaaaaccgtaaaaccaaaaatccgaactgaaaccaaaccgaaaaaccgtatgcccaccactaagaagtaaagaagagcaaaagattcatagcttctatagttgcagtagtaatgacaattaatatattgtcttgataggattaaattcattttgttatttaacttaatttttcatgttaagatcttattccaagtttatagtttagacaaaatttcacttaattaacgtatccttacaaaaagttatactcatatggaaaaatgaaaaggaatttgaattgaatcaaactgaaacttcatcgaactaaattattatgtttcattgtaaaccgtaaagaggaaaagatgttaacaaagaaaacaaaacaaaaacaaaaagaagaagtaaaagataaagccatacctaaaaattccttttttttttaagataagaatttttatatagatgccaattaaaccccaaactgtttcttaaactgtttctccctttctctaaattatatcaaatagtttcttcatttgtttgctcaaaatgataattgtccaatcgaaacccgaacttttgagaattttttatttttattttttcctttcaaatagtgcatttgagacgataggttggtgacttggtgtgtcatttacacgtgcgtatcgtggaaatgtatcaacaatttacacgcctcatgaaacgtcccttggttaggttggtatagtactttgagctaaacaaaaatataaatcgaacaaaaaacgctgcgtttttgtttccacatctctttctctttctctcttaagcctcaagaaagaaaa

SEQ ID NO: 4167 - DNA, 2000 bp, Arabidopsis thaliana
aatcataaaatagggaaatataaggaacataataaatttaaatcagaattgcaaaacatctgattgacaaaaacaaaaacatgtatatatatattataaatttattagttaaaataattacttagttagtgtaccaaaataaatactagttaaaaccaaattatctaacaagttcggaaacactatgatcacgttttctactaatgagatgcaatctcacggcgtatcaggttgttctattctcttgagaatcaacaaaaaaactttttaggcgatcaaagtcataattcataatttgtaatttgagctttagctaaaaaataaattgtaatttgagacgccggataaaattacaaaaactcatagtatatgctacaaatatatatatatatatatatatatatatatatatatttctgaatggcgacaatctaaagaagcatatatattacaaaaattgatttctcattttgttacatgtatactctcaccttttctgtatagtataacaataatagtattttatatggacaatcttatataaatatctatatattatcatttatgtaagtgttaccctttattattattatttaacaataagtaactaaataaaaacatgagtagtattagcactaggtattttttaatgattttgtttttccaacagatttattaaattagcttatacaaatcaatatgaaaaaatattatttatataggtaattatatgcggttatgaaaaaactgttgtgtcaaaatgttatttttattacttctgttagttaatatttggttttcttcaagaatatatagatttttataaatgtaacgcaattgtaccacatggagatggagtcttcatactcgcgttctcatcttatttcttttagaaaatagctagtttcttatgcattcacttggttttttttttttctaaattacttatagtttttaaacaacatgtggtataagtaaacaaatgcatgttatttttcatgtttcattattccatgaagttatgtgaattatgtatatgttcgttgaaatcatgttttcattaagtcttatgtgtttttatgaactctcttctacaactttcgtggaactatttttgttttgtttggcaataaaatgttaaaagtggtttgttcaattagttttttttttctgtcaaccgttagctagaacataatatttcatctcaacttagtccgaattatattttgattttacacttaagaaaatatttctttatcaaaacttcattattttgtttcatccaaagattattattcggatcaaattacctaaagttaaatgtttgaaaaatgtcttacacatgtttttttttttttttggatcagatgatgataacagaagaagaaaacatcatacttgcatatataatttgaaaaacatgtttttgtttagtgtctaagttatatatactgctatactcaaattcattcattcaaaacgtatgaactaaagttttaatgtcacattatattttctactagaatataatgtcaaaggaaaggaaaataaggctttagtcaacaaaaggcttctacatgtaacgagacaaatatgaaataagagaagagaaaaagcgtgcccctatatttataaaaatattacacaacctgacaaccatcaaagtccacacaggccacagccttggtaaggttttttttttgtcacctttctataatatacatgcgtcaattagatctagatctacgtgtgagttgtaattgtaaccatatacaatcatttttttattattatggtttcttaggtgttaggaagattcatattgtcacatttcagacgaaatagaataaaatatgattgtctatgcgtatttaaacccccctttgtagttcttctactcactcacaaaattaattcttcttctcttttcttttcttaaaagagctcaaaacacacgaccatctttccgctgtcttcttagcttcttatctaccgtaatc

SEQ ID NO: 4168 - DNA, 1345 bp, Arabidopsis thaliana
ctgaaagctgctcaaggctttgcaagaattcacctgttccaaagcaaatgacaagtagactcagattctataacatgaccttaaaaaattgactctgttctaaagtattagcaggcactaaaactattcaatcatcatcaaaagatttcgcattcctttggttcaatgtttctccaaacgaaatttagtatccagattaatcaaatttctatacacacaaatgggtatcagcaaaatccaaagaaatcaaattatccaaacaataaaccacaaaatggcgaaactggtaaacacctagaaaccaaaatcgaaaacttgaacttgtttaggtaagcaatacgaacctggataaacgaaatgcacaacagggatgcttacaacacaaacaaaacgaaccccaaaaagagtgatttgaggaagagattgaaggagaaagaagaagaaaaaacagtactcgtgttttgttgtttacaagatacgacgtcgcttaacgtaaaagaagaagaaaaaaataaaagctctgtaacaggccagcccaattttagcccgatatttttaatggacctggacctgatcacaaatttcagccctttttaacatccttatggatcaacatgggactctctgactcctccggttccatcaatacctgcgtttgttgtccttgttcacgacgattcaagcgaagaagcctctcgagtttcacaggtctaataactaaaccgagtaatcgagtcgaatgacattaaattgaaccgaaactaaaccgtattgctttaggttcgactgacaactacagtacgtgagttaggttcggttagagccgaatctgtgtctctttgtcgcaacgagatggctaaagttatccaaaaagacggttagagccagttgttagccccaccatgacgacacatggggaagctcatgcaaagattagagaacacgtggcactctctcgtgttcagaaaaattccaaaagagtgttcagatttgggcacggaagtgtgaaacgtgaagcaacaatcccttttaaacacaagaaccaactcaatacgcatcacaaagaaccctaaattcctggaagatctcaaaaggaaaattcaaaaccaaagcttcaagcaatcatcaagcaaaggaaaagctcaaattttgggtcttttatatatttatttcttaaagttacaatctttttgattgtggtttcagtgtacgaacacgcaagaactcgcgtgaaaaaattgtatccaagcttcgtgaaaggagtctctctgtatttagtggcgttttgttctgttgttatttctgaaatattgaagcttttgatttgggtttcaagagagcagag

SEQ ID NO: 4169 - DNA, 2000 bp, Arabidopsis thaliana
attggggcccatttggtgccacgttttttgtacggaaccgcccgacgtggtaataattgtggatgttgttctttaacaggatcgatcctttgatgacgaggcgaccaattgtcttgaattgattctagccttgggttcgaaccgacgtggtgttatttgattattatatttggtttcagtgtcatacactctacacgagcctccatttcaaatttaataacaaatctttgttaggtcatattgtctagctaatataacaatgcgactagcagaatgtatgtactacataatcagattttatatattcttgataatctcttacagattttttataacaactgattatatgtaatatatgagtttagtgtcaaagaaaattatgataatatttttagaatcttgaaaaattaataacaagttatttacgtatggctgtggctgcttcattagtcattacgttagtcttttgaaattttcatgaccacaagaaaatatttcttccggttttgagatttttcgtaacaaacaaaattgaataatcgatgtacatcactaacttctacgtggcttgtgaccaagacaaatgactgtataaagaaaagaagtcgtcgttagggggaactcattttttatatttctagggctgatatttgatttgacaaaaaatattgtccaattatatgaaaaagtattacttaacaattcttctaaccattataatgaaaacatttctagggctgatattttagttttttgtaagaaaatcatgaaatgcattttgttttgtttgttttattacatgggccaagatatgaactctcaatttccaaatacagagacagctgaagatcaaaggataaggagtattttctttttctgtatacgtttcttggtttcatatgaacaaaattgattatgagaaaaagaaacaaccattagaaatatttattttatctagctatcttcaattattttgcctaacttgatgtgtcctttaggctttaaaaaaaaaacttgatgtgtccttttaagtgacacatcaatgaaccatatgtatagtctcttgttgttttataaagatcgattgaatttgattttcctctctatctatacgtttttgtttgtttaaaaatgtcaaaaatttgggtatccaggatgttcgaacgcaggacacgtatgaagtgacgtctttcaccgccgtaaatctttggattgacagtccggtaaaaacagattaatagcttgatagtccaaaacgcacgtataaaagtttttgcatgttgaaaatattcgtatccacacaacattagagatcaatcatgaaaccgatatattgaaggtcacccgacgtcaaatttcccctgaaagggacacctcaaaattacgtggttcgtgtaatcttttttcctttaagatagggatcggattatgcagtataaaattaagcaaatcgtatttggtgatatatcggttctaatgcataacatcttttatattcacacaatgaaatagctatttgttttcagtttcgagctaaagcccaagctccagcccaaatcaaacccatttgtacaaagaacctcactcatctatttgtgcacaaattctcggatttctccaacgctctcaatcattttataaaaattagaattatcttcaatctcgatatacgaacctaaataattgaaaacattttttttctttttatgtatttttcttttttatcaaatttctttttatgtatataaaatatttgtgaaagtttcttccacacatataaaagattaaatttctttttttatcccaagcttgaatatcaaaacatgagacaacaagagcaagtattagccaccacaaagcaatcatcttaaaactcaaaccccaaaacaaacaaaagacaaaacccgattgtttcgagcacaaacgtcacttgtggtttacatcgtcttcatcatctccataacttcatatctcctctccttccgctgccaccgttagcg

SEQ ID NO: 4170 - DNA, 936 bp, Arabidopsis thaliana
agaaacagtgtgtgatcgaaatttgttcgaatttgaagtgtgggttctgctcaggtaaattaaagtgatcaacttttcttcattaccttttaaaaatattttctctacttgtaaaagagtttgtactctttattgttgtccatgtgctcatgaagctccaatgttttcgttgacttggtcacaaactcaaacaaacaggtcatcatcatttttttattatattctttaacggttttataaatttaagataaacggtcgaaattaaaatcacaatggttaagttcgagtttttgaggcaattgtgaatttgtgagttcatttattcttcttctggtcaaagtttgcaacttttggctacaagcacatatttttctgagtcgtcgtcactgtctctgtctcttcaaagtcccacgatagttgaagtttactttgaatctggctcatctgaattatgcattgaatgtgttcgatgaaatgcctaaacgagaatttaaattggttttatcattcttttgttttttgctggtcttctaaggttttggatcttcactttgcaacttgcaaaacgtttgtcggtaatttccagttttgtgttgtccttctcgaagaatgcaaaagctcaacttcttggcttagtagaaacgagaaagttgacttatgagtaccacacgttattttctgtggacagtaaggttgggagattctttgtcaaggtcgtctattattttattatttttgtttctctctttgctggtcaatagggtattgtttagtacttgtaatattcaaagaagtagtgtgaaccaagatctagatatttaattatctcaggatacgttaacataaaagtttttttttctcttggtctcaatgctcactctatccccatgaagttttgctcatactcaagttatcttgcagagaaatagaaaaaag

SEQ ID NO: 4171 - DNA, 2000 bp, Arabidopsis thaliana
tctcattaagcacctacttcccacatctttcttaaagtttcttacataaagctcccttcacacgtgcttaccaaatcagattgtcaataattcttgctcaataatttttcgaaatttatttgaatttatctaataaaaatacattgtttgagtatgatattttgcttaagaaggttgattattctccctatcaaagtctaaaaagaagattacaaaacaattgtatggttaaattcatataaatttgtgactagtattttaatatttacatatatacaaatacttatagatgaaacgagaatgcagaaatgattatagatagatcagtgacagtgaactgtagcaaccggcaaagaaacctcgttagctggacacacgattacgatcatgcccccagtctcctctgtccagacggctgcattaataacaacgagctagagggtgttttcgtcttttcgatacttatcccaaaaccgacaatctctggtttggactcgaaggctgatttggtcaattcatagcaaccgaacgagcagtccattcaagtccaaagagctccttagtggtaaaagatgtaattacgtagatgttccatggtcaagaatgtattcagtcaaaataaatatttgaccaaaactttcggttaatttcctaccaccagcaaaattataactttttctaataattatcaatcattttcaatctcttttaattttctttttcacttttttttattaattaaagtcaattcacactatacaaaaagaaggaagtctaaatatttttttactttcatgttgcttttctaacttttatattttgctcttctcaacagattttgctggtttttgtattagaaatattattatgtttccagaaatgaattttttatatgtcgtctggattcgtatatatatattggaaagtgaaattaattcatttgatttttttctttgatatatcgaccaaatcaaataaatacgaccccattgtggcattgttaatgcaaaaaggcacaagtacaaaaaaaacataataattcactattttatttacagacacatgggcccaattcatacggcccaattaccataaacctctcttttaaagagtgggttccacagtggtaaactttttgactatccattggaatgattgcatctggaccgttcatctacattaattattgggttttttcgctttaaagcatcaattaacttattacgtataggattagattaccaataacgatctttttagcttttgtcgttttccgataaaaccatacgattaagaatatgacctcttgtatcttttgagggattttagttaatctttctacatttattttgttggatgctcatacaattatcctgtgtctctcaaaataaaacaaaaattactctatttattagtacattacacatgattatttagaaaatgtatattgtggtcatatgaaatgagaaattaaaggaaatttgtcaatacttgagaacatcaccattcaaatgtttcaagaacaacatgactccaaaacaaaataaatgaacctttccctaataatagtatattctccatcgtacaaagttctaaataatacaatattcatttcgtcaaagcatatgatgtgttggaatcagaattatctgcaaatgtttgaatttcaaatgttagtatcaggctatttttactgttttatcaaatatcgtttcttctgcaatctatcacttgattgttttatcaaatcagcactagtattattgattttgtaatttgtgtttgtctacctccaattactttttagtgttatgattagtaatgtaataaaatcacaaatctgacgtggcacctatatacaattccaaaaacaagtggaacgaatataaaacaaattcacaccttcctcatcttcttcttcgtcttcacttaccttctctctacactcacaccatctcacaaccctaatctctcccacacaagagagatagagagaaaca

SEQ ID NO: 4172 - DNA, 753 bp, Arabidopsis thaliana
tctgtaaatgttttgattcttctctgaaaacctttgaaatgggttttgtttgtgtgatttttcaggcagcctggcttgatcttgttgtgaataaaacatgaatgtgaagctgtgagatactttttcctttgtctcattttttttcttccagtttatcgttacttgatttcgttttaaggtacaatttgatagaagtatatatatatgtcagtaagtttagaaaattggataagagatttatattgagtccacatatataaatatgagagttgaaagatgatccactaatcatctacagaagtaaaagaaattgtaaaataaatggcttagacgaaattagatggttcctagttagtcttatattttctagtaggtttgaaaagtattcaaactctttagttttctttcctggtacttgtggggaaagaagtgagcaatgaacacttctaatttaaataacgttttcacaccaagtcgttagtttcatattgtgagtctttgaatctactaccatcatggacccccacaacctcataaagactccacttgtgtttgctactgggttttataattgttattgatcaacaagttttgttctttctgctgttggatattgatttagttcaaagaccatactgcttttgaataattccaaggtcaagttagattgacttcttccatttttagactcgttattacattctggggttttctcatatagattacagaagaagaaaaaagcttcaagcgtcc

SEQ ID NO: 4173 - DNA, 2000 bp, Arabidopsis thaliana
tgtgaaacttgtcgaggtgagtttcttagctggaaataaaagacacttaaagcaggtaaaaacctaagtagtaagtattgcataagctaacaattcttatgttcatttgcaggggtatgtcgaaaagtatggtaaaccctgagttatcaaaccaaatgtcacttggtgtggcatgagctcaaactgatgagattcctgtacattatgtcatccttcttttactcagttatagatttagtacgtagcacctaaattctttggaactccattcctatcctttaccgataatggaataaggttggaatgggagcttggtggaggaaatgtgtacacattgtaaaactcttcaaagcttaatttatgcttaaaacagttttcttttacctttgggaatatgatttagaatgtgatctttagaagtaatgtgataaagaatggttgccttggaagcagaggaaaagagaaagaaatggaataatgttgaggtacgtttcctaactatttgataagtaatttagctttgtgaaaccaagatttttcaaattagaagttagttttagttttgtatttctccatcaatataagtaaaacctctgtaaattaatactcggtaaattaataacctctataaattaataatttcttccaatcccgaggtgagactaatggaaaaaatgacataaatcgataaattaataagataataatttttttgaaaatcctatgtaaatatatggtctcattaatatcacaaattaataattgcagaaatgtatcaactatatatacattatatgtaagaaatttctttaaaatatatttctaatatttttttttgcttaaatttgtatttattcttatttgatattgagttctaatattttattgtatcaaaaaattttggtgttgttttctaaatatgatattactttttacttgtaattgattcttaaaaaatattttctataatgaaaaaatcttaaattttttttaaaagttaataaattagaaaaatatctctataaattaattaattaatcgataaattaaaacctctataaattaatataatttttcggtcctaacattattaatttatagaagttttactgtaagtagaaagtggtttttggtttaggataaagtgcatacgttttgtgtacagttttggaattagttttatctttttcaaacattttagtgaatcatttggactatgatcattaggacatcatgaacttattatctatggtgggtttgtggaaaactatttgattagagttactgttgcttaataatattaacttcacaaaataatcaaaatatgtttgttgttcctataatacttttccacgaaagacttgggattcttttgatttaagggtccctacactttatgactcgtcgtccttatccatatctccagctctatacccaccttgcattttttttatttccacacttctccctcactgctcacgcttctcatgatcaatggtttgatctatattataacattaatgttatatattaaggtcctttaaagtaggcttatccacatcctaatttccaaagatggcgtgtattttagctctaaaccctggaagttgcatgttatattaaaatgttgtaaaatgacatattaatacataacacacaatttacaattatattatgtattcatgttgtttattgacagagaataataacattttggctaaacgtatcaaattttaacgaaaattctatgtgcaagtatataaacttcatttggtaattaagttatcaattacttgtcaattatttctagtctattatagtatttctctagatattttgtgggtcaaataaaaaatgagagaactagtcgacaaaggaaaagagatatttttacgaatagtttaaaaatgagtctataaattagatgaaggaagccctttagtaagtacttcacacttgacacaattctatccaaaatcaacccaaaaaaagaaagaaat

SEQ ID NO: 4174 - DNA, 1507 bp, Arabidopsis thaliana
tctctctctaaaattagggctcgaaatgaattgttgaacaagatagagatctttttctgatccccgtcgaacatttattcaaggccaaaaaaagcacacgggaatttagagtaccaatacatatcaaaacctaatgggctttgaatggttgcatgtgtgtgtttatttctgatatgcaaagcgatcgatagtcttttccatacaagtgtaaactgtaaacaacgtaattaagcataacaatacaactctttcttctctttttttttgtaaacacaaaataaaattacatcaattcatgcttttcctagttcatctgacattttccaaaattcatgttccattgagtccctaatacttgttcatattcatattagggtacatgaataaaagttatcattcttgaaactactaaattttcatagtttatttttcttcttttcgtttcactttcgaacaaaacactacgcgtggcatttgcaatgaattccacattatatggaataacaccatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacag

SEQ ID NO: 4175 - DNA, 2000 bp, Arabidopsis thaliana
taagggaaatagctctcttgatcggggtgacactccacatgtattacgtttttctacttttggcattaaacattttttggaagacatcatattatcagtgaccctctaagtaatgtgtattctcgttttgtttgctgttctactagtaatttaaaatagtaatgacgaacggaaaatgagaagtacttgaacttgtaaatggagggagtagacgagtagtagacacatttcagcttgcatgcctccttaaagtgcatgttcttacacatcagcatctaatatgggcatcgaaaaacagacaacggggaacaaaaacgacaaaagagtttaaaagttattattgtatctaaataaaaatttaatcgattttttttgggagaacccggttttaatgttatagtatagtaatcgattgtttttgtgtaagaaaaaattaaggcttgtaataatgtaagcataaataaaagtaaagcttgtaaaaaatgtaagaatcagatttagacgtttaaaaactaaggttaaagtttgagttattactgtattagaaaagaacactgatgagagtctagagagtaaacacgtgagaaccacgtgatgatgtggcggacgcgacgaaccgacgtgacgagtgtatggctgcatgctgctcggatgcttccacttggatccttgtttctaaatttggtctgtcttcctctgttttgtaaacaaatattagcaaggacaaaaaatacataatatttattttcccaattcattattttagagttttgtgttattatgggtttttttatgcgtctttcattaaacttaattttgagataaggccttttaattctcaagatttcctttcagacccaactaaacaaaaaaaaaaacctcaagattctcaatatgtgtgggcccgatttagaattaagcccattataagccatctacaaaagcagtgtctaagcccgatatagcccatgcaactcaggttggaatttcattacttttgttctccaactgcgtgccgttttcacatcaacgaaagggagagacgtcatgcatgcattctagaacaaatgtatacacattttctatgttgaattcatgtacgggatttcatggtgttggtaatgaaccaattaattagtttattgtcttaaatatgcaattgttagtgataaggcaatataaacttaagggtcttccactctcccacatgccaacttgtgtgttcccagctgtcacttagtcagcctgtccactcattttgttcttttttacaaaaacacacacatcatatattcttctaacatacattacatgctacatgtctacgcatctatatgtatgaatgcatcaattgtatgtatattgcggattacgttaattacattatttgtaagtcatttatgctgtaaagttttgtattctattctcagttaacttctaatgatgatatagtgatgatactatctataaaaaaaaagttctgatttaataggacctatctaggtgtaggcttgtagcaataccaaatgtagaaggttttatgtccaaggatttttcaattttctccatttcattccctaaattcctatcccgatttacgtccaccttacaccgtaagttgtgttgtcgaacattatcttccacacatattttatgtaaattattgactctctcgatcccattacatgtgatgtgggctctacctacggttccaccaacctcatattctaatctaatatttttctcatatgctaattttaaatactaaacgaatcttaacggctgatatattcgtatatgaattcatctacacaacatttatgttaatgatatatctctagtctagacattatttgtctacaaacgttttgtattgacttggccatctcattccaacaagatacaactcatcactccaaacattcaacttccatataaaccattcccttccgatctcactttccaaatcactcttcacactttaactaagcaaaccaata

SEQ ID NO: 4176 - DNA, 2000 bp, Arabidopsis thaliana
gctttgcatttgactttaaatctcatgacacctttggtttttcacatagttgaaatctagcttaacctcatagttaacaaggtcataatatttcgccgaggcataataatcgaaagagtcaaagaaagcgagagacgcacgatagaaagaaaaaaactagatatattaaaaaaaattgtttttttttttagatatattaatttgactaaacggctacgctttgtgcccagtcttcgtagagaatcgctacgtttttattctaaccgaaacaagacaagaaacgtgttttcgattgtgtttgtgtatgccgataaactattatatttttgtaatttgatttagttcaagaaattgttgtggcctatcggctatcaacatgctttttgtaagagagaacttgtaatttctgtctatgatttccttcgttttctttttctctctcaaagtcatttatttaaagaacaacattacgtgtgtataattgtataattttttctatttcttactatacttagagaattacatgttataacaaatgatctttgatcaaaagaaaaacaacaacaaatgatcaagaattgctttcttttttttatatgttgcaaaatgaatagacgagccaaacttatactcaaatattgttttatctatttttaagaaatattctttatgcgagagagcaaactccccaaacgatgttaaatggatcacaacacataagtcgatccgaatagttgaagttttctaaaaaggcagtccctataattgtattaaacacactaaatcctccacacagacaaaaagaaatcacgtaaacgagacatttacatgaaacaatcaaaccagtttgattttatccgattttgctaatgagatgagttctgtatattgttataatggatataggagaactaactaaaataaaaaacgcaaagaaaactttatacagtacatattcttacggtcttaccaattatcaacgatgtgttggttatgtacacaaggtaaaatacatcgattcatattatgcataatataaaaaaaataaagaataaaactacattttggtaacttgaattcaaccatgaactgtttggattggcaaacataaactcaaataaaatatctaggtataattgtggttcatacaagaattacttcatactgttgggccaaaggacgtatccttccccgcacctccaaaccatgggcttactactgatccgacatcaaaaccgtgttagttgcaaccaacgaatgataagtcaataagattcaacttgtcaacaaatatacagcttatatgacatgtctggctccaaactgaattttagtagaaagttactaattcataaaattaatttatatacaatttttcaatttttattttataaattaaagaaaaaaacatgaaaaatacgggaggttcggcaaacacaacatttaacttgccaaacgtatcatctaactttcccaccttatacaaggaaccattttttcaataataaagtttttttttttttgtcttcgcaaataagagcacgaaatgtttgccaaacgcatatgcaacaaacccacgttacataattctgtttacagccatagagcaagctatattgttaaagacctaaaaaaaactttactataacatatagaggcttcgagatatttcgaaagactcaacttatatataaataaactcaaaaagaaaacacggaggcgagaggatcatactctcacacagaaagagtcacattattatatcctctaaaaaaccaaactaaaacgacacgtgaagtcttgatcagccgataaatagctaccgacataaggcaaaactgatcgtaccatcaaatgtaatccacgtggttttagattactcgtggcaccacactccctttagcctataaatataaaccattaagcccacatctcttctcatcatcactaaccaaaacacacttcaaaaacgattttacaagaaataaatatctgaaaaa

SEQ ID NO: 4177 - DNA, 1282 bp, Arabidopsis thaliana
acaaaacccacttgctctaatcaaagaatcatgacacgacagctcacacaagacttttgtgttttgcctataagtgattgtgactgtatatatataatctatatataccgttgtatcttaattcttaagtcgtgtgattatttagaaagaaaaaaaaagaaaaagaagaacaatagattataattaggaatggtgtgtgtcgttgaataaaagcaacaatgaattatgacattttggacacacgtcgtgtggactggtttggactagttcaaattgattatgtaattgctatagaaatttgataataacattttttttttgttaaacaatagtaacatataacgaaataatatcgattttgatcaatatgtttttttgttgttgttaaaagatataattttgatcaatagtttataaccaaattatttaatgacgcatctatttgagtttgattgcttatcagagttaagatggtggaagaaaacaagaggcagaaaaagaaacaaaaatagatatttgccgaaatatccaaaacaaataattatttttgtaagtttgctatagagtgaaagaaaaagattctatattgttgcccccacaaattttggcattccatctctgactaagagagtatattcagttttcggatttatctaaaatttggaataaattaggctcctatattttttatttttagtagtgaatttagtccgaaaacaaattgatcccatctaaaccaaacagaaatagtcaatccaaaaacttcattatagattaatttagtttcaaaactaaatcatctttttattgttcaaagttcaaacttaaacacacttgacatgatcacaagaaatagtgcttatttttctcctttggcatgattctctcatgttctttcttttttttcttttcaaagactcgtcttttttactcatgggatttgtgaaacaaatgaaagaattcaataatgtgtccatttttttgacaaattcctttataatactccataactcacgaaccaatgtttaagaaggaagcaacatcacgcaactgaattttcaaaatatgtccttttcggtttcttttgtccaaatttccaaagaaatgtctaaatgtgcaaatatatccatttataaaactaaacaagtaaatatccaattctagcttttgcgtgttcattatataaacaacgtgtctgttctctccaatcagataaaaagattcaattttatttgatagcccggcgattaaaaagattcctatcatcatcactcgccggcta

SEQ ID NO: 4178 - DNA, 1797 bp, Arabidopsis thaliana
tccacattcctctttcatcgacaagttgtttcttgctcggctgctccaataaactgcgtgaaacatcgagcagagcaagtctctatggtgttcctttcttctgattatgttgcatacccaaatactacctcaagctcaatcaatgttctatgtataaaaaaatctcatttttcaactatttgtttgtcctactataagaaaaagttctttattgaatgattgtaaaaaaaaaactagccttcatgagttcatgttgtttgcctagtgttgaaaaattactcgtgacttccgtttcgagtattcacattcgcaatacgtggcgttttcaataggaagaaaactacacgctgtttgaattttataactagacttcatgtcgtctaaaagtaggggggcggcttaaaaccctaaccctagtttggctgactccttataaatacttctctctccgccgtatataatcttaagtcatctctgatctccgagtgcaactcaaatttgaatctctggcttcttaattctttctgatatttcgttttattggttaatctgttttcgatttcatatcattagtctagtatttgttcttctttttgtgtttgattatcttagaaaaaagggtttctcagtgatgaatacacagatgacgagtccgatgaaatccattcattaaatcatggggacaaacgaggcatttgtctgagaggaatccttttatacttttttcaatcttattagttttttctgctaaatgtttttcaaagttgtttgattcgtgattctcgaaaattgaagaaaaaaaggcatgatgaggattgttttattgtcatctgattctcatgatgaatatatacctcctactcattctgagtgccttttcttaatttcttaccatgaaacttcgttgagtctataaactttattcgttctatagtctaaattattgaattggatacttatcaattgatcgaaatctagaagtttgactgtctcagcagtttttgtttttaaaactaggaaatttttgataatctgtgcaagctgggtcggattcatagctactattgtgttcttggttctggaaattataactgttatgttactattgtggatgtgaggacggcttttcatggatgtactctcaattctaactatttgacatggttgcgtaagaatcaggagatgaatgtactgaacctaacagataaacaactgatctttagagaagcactgccctagatgtgtatacctcgaagtcaatcgatgatacttctctgagaaatcacttgtaaactttgattttgtattcaagaatcttaatataataaaataaactctttattcattcgttgtgtcttctttctcataaacaaccttcatcatcactattgaaatcttaatattaatgatatgcataagtgatttcattctgcgattaaaatgttgtgatatgagaagcataataaccgaacatttagttatcctttctctggtgtattccagaccggtcttgaaccgtttctagaaccaaactatttattcaactttatatattccagtggaattgataacattataatcacgtcatcaatactgattgggacagtatctctatttccacatcagctttagacacgtggctattgatcgaccatatagtcatgaaaacaatccaatggaaaattttcaaaacttatccgaccttatcttagcgaaacaaaatctctcctctgattattactactcaacttcgcattatcactcaaacaaacatattgacatctgagtcttgtcatc

SEQ ID NO: 4179 - DNA, 1060 bp, Arabidopsis thaliana
tggatctgtctacctcgtttagttcttgagctcactattttctatctctagatcacgtacgagctcttggaatttgtaatgtattgttcttaattagttgcgaagtaaaataattaatactgtttaaatcctcaactctgcttattttcataagaaaaaaataatcaattaatgggtaatttgatagacctgagaatataaccaaagcatatatatgacctgctttgtgctcatattagacaagtttcgggccatacgcactcattagaacgaaatgattgaatttggtggaatcatttaagacttatggatttcaaattacataactcacttgagtcattttatttacttttttttttgtttttttttgcaattcttgttgtaatgaaatagtggaaatggtttcaatttttaactgttccaaaattattttataataagtgttgttttaggttttaatataaaattttggttaaagttccaaattttatttatactgttttaatgtgttaactagaatgaattaatcatagtaaaacaatttttttttagtttgtagtatttaaaaaaaacgaacacttgatctgaaatgcatggagtattttcttagttacgttttcataggtgagaggttccatttgacatgtttttttatatattttattgaaatataggaatatgcatttaaatcttcttctgccctcaatgcatgatcgatcttcttgatactagtaacaataaatgtatcttgaaaattaagaataaataaaatagaaatgggataccagttgtgcattaactaggtgtgtagaaaaaagaaaaaaatgaacctcgagcaacacgttatcatatattcatatttaaataacaatatttttcaattgctaaattgcttttttcttaaaaacaatctttttgataaaaaaaattcagttgccaaattgtgtagtatttacaatataaatataacgtatcggtctacgagctaagacacaaaagcaatcttctactcatttactgttctgtttcactttctctctctctgtatactctctaaatg

SEQ ID NO: 4180 - DNA, 2000 bp, Arabidopsis thaliana
taattttctatgcacataaaaacatttaacttatgccaatatatactttttagtttttacaaccaattttagtccactttcgactacgcaaagatgattttataaaacttgaaaatgacagaattaagaggttggcatcggctaattgattgcatgttataaaaatataactggatgactttctcattacagttttttttatcgacggctaattcgattttatccactgcatttagtttcttataagttctttactgcatatatatatacgtaatatatgtatattataatttttctttcttcctctactcgtcctaataattttgatgaaatggttttgtatttaaaaaatatactaattatattttcaggatacaacgacatttgggtagtgtaaatgcaaaataccaaaacaaatatatactatatgttatacaaaaattgtttaaacatgtaaaaaatgatatgcataagacaaaatcccattttaattgaaaatataatatatcattcgtgacgcagctgacgctattattaaaattgaggtgatgatctatgagattttttcctcttacaacaaatatgtcaaaggagacaagccagttgtatatacaagggattgagtgttttttccgttgtaatgatattcttcaattatgctattgtttgtatgatttcttaagactcgacttaagctagtagctttatataaataaaatagctttgttgtaaactaatcatcatgaaatttcaaataacaaaaaaaaactaatcatcatgattgtatttttaaaaaggaaactctctttcctataatacgataataatgagaacgcatctcctatcataatatacgtttctaaacacttattgttgttctcgtgtagaagcatgctcgaaattaatcaaaattatctttgtttttgttttgtttcacgttagactagcctcatcgatgtaagattaatgaaagattacccgttacaagtcggtaactagtaacattagtgtgtatataaataagaatattagtggttacgcgaccaaattattgcatagtggaaacatttaaggctatttttccaccattactttgcgtacttgaattgaagaactctttacattctcagcacatcaaggtgtctcctttgagatcaaaaaagtaggaaaaataaaacgaaaaagtactataaatattaatttcgtttacgaacaaaaaagtattaaaattccgtagacatttttggggggacaataattttagactcgtacaatgctttcatggaaatgagtttgttgttgaccgatggcttccctttatttttctttccacttttttattactaattaggaaactagtaatatttatactcgatgtataattcactaatcatatactttccaaaacgtagcaaataattcgactagaatatattgtccgtgaattaagtttcctcttttctttttttatgttaaccatcatgtttctgttatttgttgattttaataaccatactattttatacttttttaaaaataattgaaaataaattcagattacaagtctacgataatgattcttcttctttttcattgtagataaatttcttaaaagttgactacttttctgtcagtatatgtcacatttttctatctatcgttcgagaaaaaaaaaagaaaaaaaaaagtttacaagtgttacctctaaagtcttaaccaccatttctttctattttgtaaaggaatcaaatagttatttactatgtttgagttcatctcttgagttttctgaataaggtggtcccataaaaggtatcaattaattcacccaacgattataaaacaaaagtgtttacaccagaatatcgccaatcatagtttctctcattttataataattttctccatcttcttccttcctcttcaagcttatagaacctccaagaaccataaaactctctctgcaacaatctatactttcttcattacttttataaaaa

SEQ ID NO: 4181 - DNA, 2000 bp, Arabidopsis thaliana
aaagaaaatcaataagcgagagaaaataataaaactattaagatgcgatctcagtggaacacgtgaagggttgtgattagatctaggaagaaaaagacatcaatctttttattgaaatccatgagcaggtgtgtcagaatccgacgtggcaaaagacagactttgatatagatcctccaaaaatcctcatgttggtatttgtacaatgtggcagagacctaaaaacctttttgttcacagccaattatctattgacatgacattaaaatccaacctcctttgcttttttttttttttgctcttattctgatcttaaatctctttatcttttttttttctttacgtccataaattctttagaacaaaaccataaaacacaagtttaatggtaagaataaaggaacaaaatcaccaaatgaaagcaaaaaagaaaatcaaacgaaatagatatcagactattaagaaagagagaccatggcattattactatatcaatatgaaagagttttagttactattgggccaaaccaaaaaaatgtttgaacactaaaataagagacaacaaactaagaaaatagtcaaagagattattctcttcttactaaagaaggatgaaaacatcatctagttcacagcaatatctggaatggagggttgcctaaacctccactccattgaatgtgcataaactactttcagatatgcagttttgtagtcatccaagagatcaagttttttgaagacatagtattggccaagttttataatctacacaacagctattacgaactcacccttatcaccatactcaacaactttttcggatcgactagtatcattactaaatttgatttggggttgctttatccagttagaaaaaactgatatccaattccaacgaggtctaatatctattctatagaaaatcaaactgtcctatggtatagcaaaatgtttagttgtatagaatctaatctaaagaaataaattatacaaaacggtaatgttataaattaggaaaacatctacatagtcaaatcctaattattacatagattgtgtttttttttttcatatcgattgtgatgttattttgcataaaagttatatgacaataaaaacttttagtatgaaattttttacctaaaaattggtagacgaatgaccgagagattgccaaagattatagttaacatttaaaatgaatacaaataccatgtaatgatgtaaaaaaaagtattaagtaattttgaagtgtcatgatgcttacagtgaaatttgttttacaatcagtgccaaattttacaactataagtaaagttgaacgaaaatcctagaatctatcaaatttgagcactattattatagtttgcactcgatgatttacaaaattctttgaatccatggtacatccaacaattatcctctattacagtttttaatgaagagaaaaatatgtagagatgatttataaagcaaaaaaaatcagtacattaataaccaatataatatgttgcttcatttttaaacgccaattataaaaaacaaataaacaaattttcacaataaaaattaacttcttttctgataggaaactaaaaaaaactgatacttttaagtttatgattaatattatatatatatatatatatatagttttgaatgatcgaataaatatgtgcgacagaaaataaaggaacaaaaaaaaaggattagatgcgaataatacacataaaaaggtaggaaatattaatgattaattaataaaacccgacaacccgacccggtattaatgagcgaaaaggaaaatatcagaggccacataaacttgtggctgagaattgaattgtgatgctgacgtgtttcctccttctcttttaaactgatcttctaaatccctaaatttcaccaattcacactctcccaaatctctcttctttaacaacaaaaaaaaaaatcacagagacatagagagaagaagaaacagaggctccaaaaaa

SEQ ID NO: 4182 - DNA, 2000 bp, Arabidopsis thaliana
ctggagacaaaaccctatgttaatcgtataaacgtttggtaagtttgaaggatgaaaagaaacgattatcttccaggagtagaaaagaaaatttttggaagctacgaggactagatcttcttgtgtagaatgacataaactatgctagtgagcaacacgtccttcagcatttgaatgaccgtcaaagttatattgtttaccagaaaagtgtatttaatcacgtggttagcggttcacttttgcggcagtttttaccatattttgactctagcaaatttagtggcggcaaaaaaccggaaccgattactcaaactggaaccgacccgaaaaattagatccgaattcgaagatttatcttatttgtcttaaatttctctaccaaaaaaccgaattcgaattcgacccgaatccgaaaatccgggtatttattcgaaaatttgggtatcgattccaaaaaaggcctgaaaatctatattcgaacccgattggacccgaaccaaaatcaaaccgatattttagaattactctattggatcctaaacttctctatccaaaaaaacctgtacccgatcggattttatcagaacctgactcgaatgcccatctcgcattatcctgcatagtaacaattggttttggatcggatcttgctgataacactctaattttacccattttttcataaatcgcatttatttttacccattttttcataaatcgcattttaaaaacatttaacgtaatataaaaacattttcactgttcatatgtccattcattttgtttttttctttgttgcgtgatttcctactatcactgtgattccgtgaaaacctaatacgattttactattgaatctgttcatctttcctttgttgcatatatatttttcctgtaatcacaaaattgaaccctatatatagtttgtagctttaacagtttattctctaatacgtagtgcaatataaattctatgtgaaatcggtacctcaaattacaacatatttgtttgattaactaaaaatacaaaaataaatggcgctaaaaatcacacagcatcaaataatgcctattattcaagtcgaattacgtattcagttgtgaagtagttgtagtcaagttgaaaataatttttatatttaatctagcgtgataattttataactatttgagtgatcgtccttgccccctatatcacattcatataaatgatacatcattcatgatctatcaactattgacttcatcgatacaaacgaaacgaaaaattacatttttcaaattattttaattccaaaaaagaaatcaaattatttctcctttgaatcgtgccgtcaaaaaaaataaattatttctcctttgtaagaacattaactagttcatataaaatattgagttggaaaaatagacatacaaattcatttaaaagaatcatatcgtcatatgcttgaacttgttctttaatgtcgtacttctatgtagcgatgtttaattaattgtttctcataaacaaatgctgacccgattccttgtcatactaaaataaacgattcaaacactaaacgaaatattataagaattttcttttttctttttttattcgtataaccaaaattaattgcacacaaaaactgattaaatatcttattaaaataaaaaaatcttctttaaaaaattaactttaaatatgttcaaaactgaatagaaactaaaacaaaactataccaaaacaaatttattaattttattttagtttgattactactgtttaaaaaaacttaaaccagagacctagaattttaaaattcagaaaacttcttttaaaacctcaactagaagaagagtaagtagtaccgcaactttttgtgatgtaacgaaataaatatgcttttttccactttaaatacaccaaagacactctcaccacaagtactcacttaagcaaacacgttccacaatcaagtaccctctctctatctctccctccctccctctccacc

SEQ ID NO: 4183 - DNA, 2000 bp, Arabidopsis thaliana
ttacaaactttggttcgaactttgttatttttgacacaaatactcacattttcttctgtgctttaagttaaataataaagggttttaactttgtctcattatagtgaattttttatgtatattcttaaaaaaaaaagtaggataaaaattaaaaaagtatatgaaaggctggaaggaatggttgccacgtgtggtatgataaccattggtatctcatgacttgtagtaggcatgtagttaatacccacgattgagcccactctcactgctctcttgggctttcgctaatggattaattagtcatataccgtttttagaggtagtttagcgattgaatttttcatacgataatcaatcatatgtcttgactcttcattccattgtcaaccaaataggtgggtgaagagcatatgtttaattatcaaaacgaacaaagttatcataccaaataggttaaactgtttccttttgtttggcaatgctaccgcaaaagtcttggaataattaattatcattatgtatgtttccgattgaaatttggaccaacctgtaataaagcaggtcccagtagtttaacattattttcttgggatctgattttttatttttttattttatcgtagtctcattttcgttattaatattatcgtgttgttggtgtcgtttgttattttatactagtattgatttaaaattaataatatgtctccctatctacttgtgagcgacggacatcttctcaaaacagaagataaaaatgcaaataaaaaatcctaaacattgacaaagattgtaatttgtaggatgagtcgtttctttcaagaagctataaaatcttaaaaacgttaaaacaaaacagaaataagtgatactaggatttaacccgtggtacaccacgggacaaatattttatttatatatataataatattaaattttatggttttaatttaatattaaagttatataattttatattaatattgtaaataaaaaattagtgatgataaaataataaataaatatttaacccgtgttatatcaatccaaatccgcttcactatataacttgtctcatgatatttttattattatttgttttttgggcaaaatattttaattattttagaagtttaaatttggaaagatttaaatgattttaagttaattttaagttagtgtgtagtatattttagtttagatttgaaaagatttaaatgatttctgtgactatttttctttttgttttctaaattttagtaacaaaattgatttatatttagatttaagaataaatttattaaaatattaaatgccaatagcattggattgtaaataaacctcaatttcaggatttatggatttatttcataaaagtgttgcaaaaatatatatatatagatgttgccaaacaaaaatattgttttgggtctcagcctttttaaatacaccagcccatatttgattcggattatcatttcttgagacttaacaacgaataaccgagattatagcctaaacgttttaggcggctaaccagagaatcaatttctatgtctctcaactcaagtgaaaagttaaaactctttctttcgaacataaactaaaaggttaggaaagctcgaatcagattattaatttttggtaatgtgaactaaaagtttagtaaaaaatcgtttcaatctttttcttatctaagtaccatctaaaatgggtttaggctcaattcttcacctaatttcatttcgaataggttttgatcatataaaaaagaaaaaaaattggttaagcgcactgaagacagttgttagcaccacagagttttatgaggagagaaagcatcatacatcatcacaaacaagtttcttcatcgctcattgttagtcattagtactttacttcttccttcttcctcttttattataagaagagaaagaaaaaaacatcatcttttttttcttgaataacagagcgattgctcttatctcagttgattggcc

SEQ ID NO: 4184 - DNA, 2000 bp, Arabidopsis thaliana
tcgctgccttttttttttttttcttcctcatgtcggtaattttgggtttcgaatacaagcaaatgaattttgagcattacatcactgttccgaagatccttaatttgttggtttttatgttcaaactaataaaaccatgcatgtcatttggcttaataacttgatgtcattcaaaaagtaaataaactggataaacatcttacgacttcttttatcggtcagtgaaaaacattattactaaacgctggtattataataaactggatgacattaaagttcatacttcattttgtaattagaaaacttctttctatttatatatttctaatctaatttatttattttccttacagtaattttaaaaatgaaaaagaatctttgaattgtagttaaatatataaatcataatgtgtaattctgtactttaatttaaattaatgaggtaatatcatggataatcattattaatttctctgacgtgttgataatcacattataattataggattctcttttgtccggtacacatatgtgtcagattatttaaggaatgtacacacatttaatggagaaaagataatgagctcatcgaaatagttgactttttcacaatttagacatgaaatttttgtcttttatcaaatcccaacttgttggaaatttgacacgtcagcgagattgatcgatacgcacttagtcgtttgactttttcaaatacccatcgctacaagagtacggaaatttgcgtgcaaccacattctaattatacgcatatctacatatcaatccaccgcaccgtctaatctactctatgatattttcaagaccttttcaaaaattcagatccgctagctactacgaaaatctaaatgactaaaataaaactcttaatcgttaactagatatgtttctataataatatatgtatatcatactgttttatttagtttgccgtttttctttgttctaaagtttttttttggtgtgtttaacactagtaatttttttgttctttttaatgttaaaatagatattttcaccatcacatatacattgacatacgtatctagggtttagatgaagacatgtacacacacgatattgatatttaactatgtgtttttccttaatcaacgatttcaatttttcacaccgaaaatgacatatgaaatcaataaaatagttctactaaaagtcctatatatgcaatcgtaagcaatttgaagagacaactaatgtgcagctaaggccactctaaatccgaccgccaaggagatcaattagtttattcactaaaggatcatcttccccttttgtgaatactatttattaccaaaacaaaacaaaaaaaactattcacagttacaatgacaaagataaccctccataattaattaggatcatagactagtaaccattcatatagaaaatatcgtcgccgttacttacgtagcctaaatgataactcatgcagtcatgctgttacagcagttcaaattaagtgtccaggttatgacttggtgaaagaggaccaaacttttaaaccttaagaaaagaagaggaaaaaaacaattagcctatcctgtatcactgtatgtaaccagacttatgtttggtttccacgcaatttgacggatacatgtttctatgataataataatgatagttttattactaacacaaccatattgttgactatccatccataaatcattaaatcgcaagatgagggaagggtagagcggtcatttggaaggatatcggcaacctttggtgataagcgagagactaggaagatgcttgcggcgaaaatggattcctcgaaaattaatatttaaatcgatagttaaccgttgagaatctccaaagaatgcttttttcattgtcaacactggctaggaaccctatataagccatcgtgtgattaatattcagacatcgatcaaataaacttgaatcaaatctcaaacttgcaaagaaacttgaaatattttataaca

SEQ ID NO: 4185 - DNA, 2000 bp, Arabidopsis thaliana
ggaacttgtaactcaaatactgaaactttaaccattagactacatttttatgcaaattcggccaaaactaaataataatatgattagcggccgcaagcttatgttttgcttgcttggccttgtggccggctaaataacctaagtatataatcaataaattacataaacgaccggataaatcagaacttaattataatgttaaaagtaattaaatgaatgatgaccctcgtcgtctctcctcttaaaacacaataatctcataaatacaatttttatatgaagtcttcacaaactactataaatttcccaaagttgttctctctctttgtccactcgaagactcatggggataagaaggcactcgtgttatgggcttcggggctttttattgttcgccctttcgaggaccttctcacatgtttggacttttgagtctaaatgccttatttcctcacgaatgacgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaa

SEQ ID NO: 4186 - DNA, 2000 bp, Arabidopsis thaliana
tttaaggggcatttctcgttgtaacaaaaagctaaaataaaacaaaatatttttattatattgaaataaaccaaacttctttctttcagtctctatttcattcatgtatttgtttaagttctaactaagaagtctgaataaatactttttataaaaataaattgatgaaggaaagcaaagctcatcagagcgtggaccaacgcgccactgcgcatccgtcactttgtccgcatggatctccgcgttttcttcccgtttgtttaatgtttctctcctctttaattattgtaattaattagtaaaaataatagactacttcaagttgttaagtttgttaaccatagttaatcgttgacaaagaaaaaagaaaaaccatagttaattggtcaacttggttaaccaactatagtttacgattttggtcttctaagtttacaattgagccaatttcattttcatccacattgtatttgatgttgcaaatagccaaataatatataacctattagtagattaataatatttcctacgagtataaggacataaaatttgaatgataagtgccgctagcaaaatactctgaattcacaagttagggaaaactcgattatgctgcgcaatcaaattagagttacataaataaaagtagttggtttcaagagtatagtgatttcttagatttgctgatgaaggatgctatacttaaaaaaaaaaaaaaattgactaggacatagatgatagatccacgctgctgacgaagacatacaaatgactcattgaatgtggagcatgttcaaaaccatgtctcatgaattgttggtatcgaaggtattttttaggatcgattaatcttcggaatctattttgacataactcgtatagtgcatttgatctatttattgatatgtgttacaacgttaacatcatgcatatttcatctaccaagaactaggactccaccaactatctggtcgagtaacacaattctctgaccctggtaaagtaaaacctatcaatactctcttcgttttgtggaaggagatcttgaaaagataaaagaatcaccagttgtttcatttcaaaagtcctagcctttggattactaagtttttgaagaaaatttaacactcggtataccagccttatttttcctgaagatttattaggactacaatctcaggatcttttgacttaaccattggagtactttcagcaaatatcaaaattggtgttttaggtctcctcggttatttccacgcaaattttcttattctacaaaggacacggaaaattcaaacagatctagttaatactttctttgtctaaatcttataaagtctagttatctgcatatgtttttagtatatttgtacaaaccatatatatatatataaataaaaaaatcccattttagtccgtgttggttatatagaatgtcctgaatccaagtaaaattatctaagacattgtacaaaaaataagattattggtttacaaaaatcaaatgaaagataaacaagaacaattatttccacattcttgggatctcgatattgtctccattaattgctttattccgtgagaagacataaaacaatggtagcttctttgataatatatacattcaacgaaatctagaaccgcaataacgtctttatacatactcgacattcgacaatattataaaacttatgagtaacttcatctcgaatttgacattaaataaacacacacagaataaaaccttataataataatagtctcttggggccattagtctagagagcagacttggtcttcttcttcctctttctctacttcatacataatttcatttctcaggtttctatatattttcttctccactttttataatttatccgcttgtctgctatctcttacattaaatctaaacctaaatcattagaatctctaatccagtttataatatacttttcatttttatcaattttttttttctttttgtgtttggtgttggc

SEQ ID NO: 4187 - DNA, 2000 bp, Arabidopsis thaliana
aacctttcgatacttaataaaaagaaataatgtcaacatggtctttaaacaataaaacaaaaatgtacataagtagaagtcaacagaaaaaggagacacttggttggatccgtaagcatctaaaagacaatttcagacaatttggaccgacgcggtttcaacacaagataagaggagtcgtgtcttgtttaatcagtcaacgtttactcgaccctttccttcctctttcccttttctctactttcttcccccaaatttctgttctaatatacgataaagatgttttttgttccatttattagttttgttcctagtttttatttataatttagtagtttataactatttaaaatgtgcagtattttaatttgttatattggttgattttttataaatgagaaaatacttgttgtttcttaatctttgtgattttagccaaaacgtttttaagaaaatgggatagaggaaatataatacagcctattgcatgatgaaatgatacaacacgtaatcttgatatgttgtacaatataaatatccatattgccatatacttaataaaaaaatacaagatgggttgttatgtattactccataaatgtgcatatttgggtacgtacagtcaacgttggatatctgcctaaaacatacaatgaattttattttcctgttaacctcaaaataagtggtacaaaaccaacgtgacaaggacgactattagaaaacgataacagttaatgtagttaggtataattctagtgtctgaaacgatctttccaataaaattatactattatgcatattgtactttgtattttgctaagtaattgtgaatcaaacgtaagaacattactttcctcctctctcctctgactaatatagggcttcttaccgtacagtcttgtggatgtgactcaaaacatctgtacaagaaatttgtgtattttctcactattcttggtccaatctgagtatttctatacagtatagtataattttttccttattttcggattttccattcacttttgttggaatttttttccagtttaagagatacaggaaaaaagttctcctcttaattactctaattattaaatttactaatcctatttcaattcctctcatttccagtatttcaatccactgatcgtccaatatgcaatatattttacctttttaacacacaatgttagtttcttgacagatttgactttgaattttggtggagattagtaaaagaattaaagaaatatgtagtggaaatataaaaaataatgaactgggatgagattacacaccagacaccacttgccaagagaacaacgggctcagtcacatggtcctaaattgaccatttccataatattagctgccaacaaaatacataaaataaaaatacggttactttcataactccccttttaatttattaatattttaaaaattaagcagaccttaattcatcatcttttagtgcgttacaaactaacagcgttacaaatctctcttagtccaaaaaatgtgactaaaagatttctcttttaaacccttaaaaatctggaatcaaaatcttttatattttcaaatttttttggaaacaaataagaatgtagaattcgatcaatatgaaagaaaaatgaacggtgttagatttgctttggaaatatgtaaactaacagtaattaacttgttttagtcattagcaactaatacagtaattaacttgtttaaagtaaaattagagcaacctaggaatatatgctcaactttttcgttttcttctaattgttaaaataatgttgtcattggccagtcgccattatacctttttaacccttcacagtctcccagaaacctccctttctctttgatacattctctgtatatatatatatacgcgtatgcgtttacacattctttaaaagtttcagattctagataaattcttttcatttgatttgttttagcaattcggacattgtacagagaaatcaaga

SEQ ID NO: 4188 - DNA, 865 bp, Arabidopsis thaliana
gttatatcgcacatttcagacaacgccaacaaccttaagatacagatggtaatcgttttcttaaccttgtaggaatttcaaggagaaaatgaagaagcttagcaagaaagaacaatctaaatggcgattgcttgtagaaaacattattagggcgaggaacagtctcgggcccttctcgtcacgttcttctggtttgatatagaaacaggttttagattttagtgtatagccagttagacacaaaaagaaaacgtacataggcgcagggtatagtgtatattgcgcaccaatacggcgcacaatagtggttttgaacaaacattgtctatatcaagttggttgttatatacatgccgagtcgtgattcgtgacagtaatgtgaagaagtttttgcatcatcactcattttatgttagaaattcaaatcaataatattggtcctaaacgactttatttagaggcagacaaaaaagatatacattaatgttatttatatcatgattgtcatgacttaacatatttcaagttgagttatctagtgaaaatatatatatcctagttcatgaaaaatgaaaatcaaccttcttgagtgttatacttctttttgtaaggataataattgatatatacggcgggtctctcgttgacttttgatggtgatttgactttgcaatgtcaccaagagcaagtagctaatttaaatcacttttaacttccaatttgtttatgtttggtcttcagactttacgtcagaataattatttttgtgtctttaaatgaaaacttcaaacttcatcacatcaaaaatctcaaccccatttttagttgtcttctttttccttgtttttcaagaaaccagacgaaa

SEQ ID NO: 4189 - DNA, 786 bp, Arabidopsis thaliana
cacgggaacttcattactttgctgttatttccaagcaaaggattgtgaaaaagtatgaattttcttcattatagtacatgcaggagttatgttttctgtgctgaaaaaaataacattttttcttggtttctggtttgcaaattgcaggtttctcgattgaagaggtagctagtaaagttccaattgcatttctttgatgcattaacaaagcattcagatttgaggtctcattcagcgagtaagatccaagacataaagatcttccacaatccgcacctcataagtataaattcaaatacagcaggagggatgtgaaaaaaaaaaggagtctctaggatgtccttaagtagtttatttcccattaatggaagattagttttagtttctagttggttaaagtttcagactttgagttcttattggtcctggagagaaaagaagtgagaaatataaacttattttaaatgttttcttgtaacttataacttcttatttcacacaccgttgacctgattcgttgcaccaactcctaaatttttatattgaaatttttatatatcatcatgcaggacccaacaagcttacaatggctgtccacttgtgtctgtctgttactgaaatttataattgtttttgatcagcaacttgtgttctttcggctgtgagctagtttaaagaacacacggcttttttttaaggtcaaattaggtcgacatttaccatataaagactcattacacactggtgggtttctcatagattagagaaaaaaagcttcaagctttc

SEQ ID NO: 4190 - DNA, 1348 bp, Arabidopsis thaliana
gcacactcctttgaccgtagagaggatgaaacaccagtgtcgataaagtatcaagtgaataaagtaatatatgtctataataataagttgaataacaaatccaaccgaggcatgatgaatcatatgttttagtcaacgaatgtaagaggatgaaggataacgaaaactaataattgtggctactctgaattcttttattactagtctataaaacaaaagaatatctgtcattagcatttagttgcaacgttgcaatttgggtgtgtttagcaagttcaagaaaagtcatccaaaacttaatgtcattttagttaatctattttgactctttctattcgtttatgaatgaatatttcggtaattaccaaaaaatcttctgattatccaaagtagatgatcagagatttgtgtccatcttcgatttatataactaattagtgatattttcttcctgtaagtaaacgatgaacctggaaacatgcaaggttttttcgactgtcaatttatgtggatgattattgctattcaatctgttcatccacatgattaataagatgctaattggtaacacatggcgtagtttagaaaaggttaaaacgttgcggtcaaatgattgacgtaattggaagaacatgcacgaaacattacaggaaacctataatgcatggatgcatgtgggatcaaataattgttatcgataacgtccaagtatcaattgatatgcatatatgtagatattttaatctacttgataagataaaaacttaattttaatttaagttattcttccaactgttgttggcaaagtattgtcccactctataaggcaagtaatacaaaatacattgttttaactatatccgaactctatatgtctttttcttgttaagtagaggaactagaggtgtcttagtgacgtgagacacacgaaattttcaattcttaaaaccccatttgtatttaatttgggcttaaagaaatttaggcagccattttttttggtggtagcaatatacaccatgcataagacaacatcgacacaaatattatatacacatatatatagtacgacttgtatcaatttgcctcttcttatttctacaaacaatgattggtcttaagaacaacaaaaatacaacaagcattccaccgcagaccaatgatagtcaactacattttgatgttaattaatctcaatcttctaaccacaaactcttataatattgcaagttagtttaaactacttacataattgagtataaaatagcttcaaccttcatcaacaattcattatcaatcgagcaaaaaacaaaagctaagagcaacaaactaaagattttttaagaaa

SEQ ID NO: 4191 - DNA, 1083 bp, Arabidopsis thaliana
aagcttacttgagccataagcaaactaatattctccatttctatctttctctgtaagagaaacgaaattcggagattttcatttgaaaatttgattctaattacaaacatgttcttgtaaacttaaagcttggtacaattgttgttattgattgatgttgtgagaaacattcagctttttaaaattgggcccagacgcaaagcaaccacacaacttacgatttcaaatcttttatggtactagttgaggttttgtgaaggttgatgtttttcttaattttttaatattctagttctcgtgtttaaaaatagtcgcatcattctttttttctggcggttcgtaattgtgttcccttgtaatactgtatagggttgtatacaatcgaacgtttgaagtgatcatgtaattcaatcataaatttaaatctttggttattgaaaacattttaagcattctatttttattgacctttaagagattttggcattttattggcttgagttcactgagcgtttccaagttaccaactacaccaacccttcggattcaaatctgtgttgatgttttgcgattccatatcattactatatcaacgagttgatttttttttttggtcaaccagcaagttgatttttgaaaaactcttactctacaatttgcgactgacgactgtttagaattttgggtacgtaccaataatccaatatgttatattttcgatatagaaatggattgtgattgatataagtcttgggttcgtcgaacaaagttaaacaaagatttgtgtaaataacaaatagataaaaacaagaatgagtgtgactgcatgaaccactaaaacatatacgacgttagagggatgttgggtaggtgaaggtgtttattaattctaacacgtgaggtttcgtaagtaggtataagggagtaaccatttgattaaaaatttgatgtcggttaagttcggttttagtatttggtttagtttggttaagaaaaaaataagaaacgtagtccatatataattcttatatattaaggagctttgctgttcaatgtaacactcaaaagtagtaacaactaaga

SEQ ID NO: 4192 - DNA, 1134 bp, Arabidopsis thaliana
atcaaaggaggaagaagaagaagaagagcctttttgaggccattcatgaattggaatgaaggatatcaaaagaatctaacacaaaggccacgtccttccttcaatctttccttcttgtaactaaataattttcatcctttctctctctctgtctctggtcttttttagctcaaagtatcatccatttatgtcaaagtgttgtaaattcctcaagactatatatgagatgttttgtttcattttccaaaatttcaaactttgtccccatttagtcttctacccttcatgcatggttagcttagcttaatgctgaactgttgaataacgatatgggccttatgctaaaagaacaaaaccttatgggtctaaaaaaaataagcccaatataaaactatggcccaaataagtttaggtccattagagtgtgagaatagcgcgtgtagtgaaccgcacgagaatgcgcgttcgattgttggtgaagtagtcgtctagattcccgggtccactgatgtttctagtgtatcagacacgtgtcgacaaactggtgggagagattaacgatcttaagtaggtcccactagatcaagatattataacgaattgacctttttaacctttcaggtagtcccggaactcgtggcctagaatacaaagaaggttgtgaacaagttgatgttaagatggacaagaatgtaacttgaacaaaagctgaatcatctcttcagccactagtatgttgacatatggcagtttcttttgtagcctcgaaataaataaattaaaaagtttgaggttaaagataattatagtggctgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaaggtacttaagattgatttattgtcatggtctttcttattgtttgatgaataacttgacttgattgttttttgttttgtggattagtggaattttgtaaagagaagatctgaagttgtgtagaggagcttagtg

SEQ ID NO: 4193 - DNA, 2000 bp, Arabidopsis thaliana
cggggatagagaagattcttttgggggggtttggggtcgtgactcatgtcgtaagttgttgcttgctacatcttttggattaagcttcacctaagctaaatagctagttgatacgttgtctactttttttttttttttgtcgttgatacgttgtctacttgtattgagcacattgatgtttctcttttctttttgaaaattcgatttatctttttttttttttctaaattgttaaagggttgtcttgtttggagaatttgttgtagacaactttatataagtttgatatattttgctttgtgcctttattctgattaattaccaaatcttaataaagcatcaatcaagactttctaatataagaaaataaataaattattatttagtggagaatccataataagttaataatcattatattcaataggacaaaacctttgggtgtgtttatattagtctacggattttctgatttgtataacacttttggtatttcagattaatagagtattatggttgaaatatgcattcgtaaaatcttcggaagttttaaggttttgtaactaataatcatatatagaatcccaatttgaagaatcggttcttcacgttggttttattgattcgataaaaagaagtttttttaagaatcaatgcgacaatgcgttgtcgttccacgagcaaggagtcccaaatctgcgatatgtttctttcaaatagcctctgagctaggcctgggcattcagtttcggttcggttgcgcatggtttcggttatttcggttatagtaatataagaaccatttggatatttgaggaattttggttcggttcggttcggatatctttcggttcggttcggtttggatattaaacttggtaaccataaataaactaaaaccgaaataaccgactaaaaaccgaaacaaccaaaaaatttgaccaataaccgatatagaacgtacgtaaaaaagagaaatattcacaactcacaaagatggtccatactctccataatattaaaacacctgattcacaactcacgaaattcaacttgcaaactaataaagagaaaaacatagttaagtgtcaatacatactgtgatatattatctatcatacatatatgctttggttttcatttggttatcggttattaacctaaccgaaaccgaaaccgaaatctaagacatataatattcaaccggttattttaagctatccaaacctgaaccgaaccatgtttttcggttcgattcggttcggttaatcggttagcggtttttttgcccaggcctactctgagcaataattgtatccggagttgtaatagaatcaaagtacgatgagagtgtttttatgacaaatatcttaatcttggccaattatatgttctactgaaattctttttgaattcatcgaccagtgagacttaaaaatagctttttattcgccgaggtatatatagctaggaattttgtcgaaatttagacgttagtgggttttgttcttcgtgacacaaaagatattctatatattaacgaaatctagcgatcgatatggtatttatataaagtcttggtcatagataggggttgaaacttgaaaccatgcatgatatgccaatgttgctgaagcagtcaatgttgctgaagaagtcaaacgtaattatatagtgaataccaaaaaagtgatatttcttaattcaattaaatataattatagttttaaatcacctaaaataagttacttattaaaaccccccaaatttactttaatatagttggtgtacatgtttgagaaagcaaacaaaaagaaaaagaaaaagaaaaaaaaaagagaaagaggttagtacacataattgggaattaatgtctattgattcttttatctttctctctctctctaagacggaaaacccctataaatagatgtctcggtcgtctctttgtctcccaaatcactacaaatctctcttttcctctaagttaacaaaagaaa

SEQ ID NO: 4194 - DNA, 2000 bp, Arabidopsis thaliana
gacctgtttctgcggctgcgattcggagccgcgtcaaatatcgcctgtttatattccgggtcaacaaccgtctctccttatttgaccagagtccttctgtttttttttgttttttttttgtggataaataaacagaataaattagggctcgaaatacttatgatatgtattccaaaagacatagctttgatcacttaaacaagccacgcctagctgagaaagaaaaggctttggctggtttataagaaattaataataactttctggcctttaatttagataaatagaacatttaatttgtaattatatattttaatcatgcaaataataaattatctcaaccaacattataattttatatatctttgaggtcattatttttgtaaagaaaaacgctagaattgaaatatttattaatttagacgaatataagttggacaatttaatccatgtaagattaagattttgtatgccatcaatctaacaacttgtctagacaactaatgtttaacaataatttttgatactgcaaaatttgtttatgtgaagttacagaacttgtaggagttagattgttaacgttacaatactatatatagttgattcacgtgtttataggcaacatatcaaattaacatgtttgctttgcagttaaaaattgttcaagaaataagccaaaattcatcgacaaatttggagctaggggagattcggtaggtacaaattaaacaaaacttattcaagtaattaacaagtaaaataaataatcgtttaccacgtgcccatccagctgtgattccacttcaacttctgactaaggaacggaaaggcattccaagtttcctcaattaggctcaacttttcagagatgaaaagaattagtatgtgcaaaataacgtatagattcacaggatgatacaaaatctttcaatgacatggttagtcaacgtaaacaaatttgttttggaagggtccatagagatttttactaaagcaacgtggagttttcatgtgtttgcaaccgttaccaaaacccaacagttagttaacaactttattataatgaataaaaataacacacgagaattaatgacatagtgtcaaaaagaagaagaacaagcatgatattttatgccgactaaagtattgtgaccatttgttgttgctgaatcgtcatctccaactcctaacgttaggcacgttcttgaaaaatatcccataacgcaaattctagattaagcccggtaaagtaaacttgaaaaaattataatatacaggttctttatttaaaggaaaatgtgacatggcagtgaggagaaactaacccatcttcctaatggacaaatgtcagcagagccatacatttataaagtattttaatgattaaggggacgatgatgatgtcatcagtagttgagttgggggtagaataggtaattcaagaaatatgtgattgaaagtggaaacgtaagctttctggcttttgtgtcctctctgagtctcagtgtcgggacaagacatgcatcagcatcacacatccgtgaatcggtgctttatcctcttctatcttttttaacttcacgactagaaaattgatttttaaattttgttttacacaaactgatattaactacaaattaagaataacatagaaattaagaataagtttctagaaatgtacatcaagtattggccgttaagtttcaacatatttataccatctggcctcaattacaatcataattcataaataatcttctgacacttaataagataacttttcaccgagtgatatattcctgaaagtaaattcaacgctttagaataatgttcttatatatttaattatttaccaaatacacactatgcttcaaactccctataaaaagaagaaaccaccttatagcacttctcctcattcctcacttccaaccgccaaagaaaaaaatcaaaaactccaacaaaaaaaacctcccaaaccctacccgagcagtcgccag

SEQ ID NO: 4195 - DNA, 2000 bp, Arabidopsis thaliana
gcttccgttctcaattattgttgattttcttctatttaatccgatgtgctaagaatgtcttatagttttaattagtggtttaataactcggtttgctttttcacctttttggttccatatacgacgtcaagactcacatcacacgcattcacgcaaaagactgatattccattccgattgtactttgaacttcaaagttattattcttttaatatctttttccatttattattttctaagttccatctatctatccctctctagagtctagcccaagaccgataatcttgtgatatttcggctgaaaatcgttttaaaaaaaaagttttaggtaaaatttatcgtcgttggtttgatttgataatatattgggttgattcgattttttagtgtgaaaaccatattacaatatttcagttagtagtatgacaagagagtctagaaacaccaaaactttatgcacacgtggacggtggtacctgctgttaatactataatgtaaatatattatgctacctttgaggacacgtagattcatttcaaagattctgtaaattgatagttatcacttatcaagatcccacctacatggctacatcattctatcctaacatatacaaatgtaaacaaactcggttatgaaaaataatatatctaaactaacaactacagtatatctattaaaacaaatatggtattccaagaggaaaacttgacaatatcgcaagaacttcgaaattcattgaatccaaacttcagcaccacctgtcaacaaaaccatcttctgatctcaatcttttacccttttttttgttttaaaggaatctttcaagatgcccaaaaaatttgaagaatgcagaataaaagagtctaatagaagtaggtttaggtaagaaagtaatttacacttacaccttttgataatgagttcgtcaaacagaacctaaaaagagcgcccacacctacccatctttttccatgtctggttttctaataatatacggcaatttaattctttattgtattcgattacgatatttccaaatctcttatctaaatgtattttggaggagaacattatttaaattaaaacccgtatctatgttgaggcatgttgcccaagatctcccatgcggctaagaaataatttagtcgtaacagattgtattagtactttagatttttcttaaacaagataacttattcgttgagacataaattctgtcttaaatcagaaatcataataatttttgtatatgataaagtatttcaatctatagtctttgaatcacacgaggaaatgtttattttttatattaaagtattagttttgtcaaaaataacaaaatggaatgatgatatatatagttttgcatacaaaagtacctaattctgtaaatttttgtaacggcataattaaaaaaattcagttgatgattctattagtttaactacacatacttatatgatttatcaatttgtaaatcagaactttataaacttccaaagttcaaagcatgcattaaaaatttaaaatcttgggttgaacatttaaatttggaccactcgagtaaactttgggttacctaaaaataaagatgttgtttgtagaacatcaaacttgaattacccaaaaaaaaataaaaagtgatcaatttttttttacttttaaataaagattcaaatatgtttgtctttatggatactgcaatctcattatttatcttcggaaaagttgtaaaactaagtttttcttctattcatccaaaacctttttttgccgatatgacatggaattaaatgaacactacttattaatatttaattaattttaatctgcaatttggacatgtcttatataagtatagatgtgtatgtgtgtgtctctattataacttggatcagattcttcttctcctctaaacaacaacaaagtctctcttccttctgtctttcacatttcctcttcccctaaaaacagaactcaaaaccaaaacaaa

SEQ ID NO: 4196 - DNA, 2000 bp, Arabidopsis thaliana
aagattatttccttgtagtctattctggctaacatatttgatgcattttcttatattgctacttgttaattaattacataaagattaaggatgtattaattttaagattcatgagctgaaggagaacaaaaagagttactatgccatttgcgatattgatgatacttgcgcttctaccacgtcaaacaagaacgctgaatactaatgcgaccgcagcgggaagatgatggcagtggccatgcccatgatggtgatccacatcaagattttagatttatatttctatatatatttttaactataatttttagtttcattcttaaaaaaaaaaaatttggtaaaacttttactagaaattcacatatattccatcgtcactagtttatccctagttagtgcaaatcacaattcgtttttggtcaattacaaaacaacaatgcatatcattttctacattaaaaacaaaaaaaattgttagtaaaaattggtatgtactaatgcaaaaatttcgagacttgaaaaagtttacagcaaacaataaaagtatagatagttgatatatagttcaatcatatttattctcaataaataaaaaggtaggtaaataatcatgagtgaactaaagaaacggtagaaatacaattgtcaccatccaatcacatttaaggtcacatttattaacaattacagctggctggatcatgattcatgacaaattgtattcaacaataattttacagtctcggttcaattataaattattctcccttttttggcaatgataaacgagtcattttcggattaacgtatatagttaggtttttggtcaatcttacgaatttgtacgctgtctattgtctacccaatatatggtctttcttcaatcattttcaaacaaattggaaacaaaaggaaaaagtctttgaatgtatgcacaatgaaaacatcaatgaatagggaagacttcattacaccaacctaacactcgtgcatgctatgtttccttgttgtgcgagagcaagtacggtgaacatactctgccgctatggctcttccacaaatcaataagtggctggtcgtcttaccatcttatgtttcgggtatactggatatcggaatccgttccaaacaacctcttatagatatcacactaaacattactaaaagagatcaatgcccattataaaacatcaaaatagagagatacatatttcacagaacatcaccgtagaaattcattaaatttaagagtttactcgctcgtatcatccaatacggttggtttttctcttaaacgattcttaagcgtcgagagtcttttgaaggccgaataacctttgataatatattccgtaatgcatactttattacgctcaaaattcttcattacatttgcaattttattatgttgtgtttcatttgaaatcaatattatgagttttaattaataatatcatggtattcttataaattatggtatcaatttgacaaattttacgtttataattttcgaatctcctaacaagcagtcaataatattctataaataaccaagtggtcgtgatctactggtttccacttgaggaggaattgccttgttggtctaggttagggatcgattctcctcaagtgccaaattgttagtcatttccataaactaaacgaacttttcggcgttttttttttttttttttgggatcttcgtcataccctatcataattcaaatacggtggtagtaatgtgtgtgtaatttatagatgaaagaaataatattaaataaaaagcaaatgtatatattttatggtatactaaagttagaagttttaaaccatttcacatattaaaaatgaaaaaaatgaaaaggcaacacatttttccctataaataccccaaaccgactttaatcgccacaccattcataaacacacaccgagagaaaatcagaaattaaattagagagagagcagagtgaatcaaaacttcaacttcacccaaaaag

SEQ ID NO: 4197 - DNA, 411 bp, Arabidopsis thaliana
ccggagtaaacctacatcgactaggtcaaagatatggcttttgtttctcctaaattaattggattgtaacccacttattcacgtttcaaatttgtagtgttagtagttaatttgtatagtttctttttttttttgatcaaaaatttgttacggaaaaagtttggtaagaatgtcggcagaatcaccaccgtcgattaacggaaagataaatctaatctaacggttattgataaagcataaaactgacggctccgattttattttctaaaaatcacgttaatcacgcaccaggtggactatcattgtctttaatctatggatttaaaaatttccgcacgattaaagagcgtctcgaaaattaacttttataggtaggaggagatagaaatcgaatcttatcgccgcgttaat

SEQ ID NO: 4198 - DNA, 2000 bp, Arabidopsis thaliana
tttgcttcaaaaatatcacaaatttttgtatgaaatatttctttaacgaaaataaattaaataaaatttaaaatttatatttggagttctatttttaatttagagtttttattgttaccacattttttgaattattctaatattaatttgtgatattattacaaaaagtaaaaatatgatattttagaatactattatcgatatttgatattattgaccttagctttgtttgggtggagacatgtgattatcttattacctttttattccatgaaactacagagttcgccaggtaccatacatgcacacaccctcgtgaaacgagcgtgacttaatatgatctagaacttaaatagtactactaattgtgtcatttgaactttctcctatgtcggtttcacttcatgtatcgcagaacaggtggaatacagtgtccttgagtttcacccaaatcggtccaattttgtgatatatattgcgatacagacatacagcctacagagttttgtcttagcccactggttggcaaacgaaattgtctttatttttttatgttttgttgtcaatgtgtctttgtttttaactagattgaggtttaattttaatacatttgttagtttacagattatgcagtgtaatctgataatgtaagttgaactgcgttggtcaaagtcttgtgtaacgcactgtatctaaattgtgagtaacgacaaaataattaaaattaaagggaccttcaagtattattagtatctctgtctaagatgcacaggtattcagtaatagtaataaataattacttgtataattaatatctaattagtaaaccttgtgtctaaacctaaatgagcataaatccaaaagcaaaaatctaaacctaactgaaaaagtcattacgaaaaaaagaaaaaaaaaagagaaaaaactacctgaaaagtcatgcacaacgttcatcttggctaaatttatttagtttattaaatacaaaaatggcgagtttctggagtttgttgaaaatatatttgtttagccactttagaatttcttgttttaatttgttattaagatatatcgagataatgcgtttatatcaccaatatttttgccaaactagtcctatacagtcatttttcaacagctatgttcactaatttaaaacccactgaaagtcaatcatgattcgtcatatttatatgctcgaattcagtaaaatccgtttggtatactatttatttcgtataagtatgtaattccactagatttccttaaactaaattatatatttacataattgttttctttaaaagtctacaacagttattaagttataggaaattatttcttttatttttttttttttttaggaaattatttcttttgcaacacatttgtcgtttgcaaacttttaaaagaaaataaatgattgttataattgattacatttcagtttatgacagattttttttatctaacctttaatgtttgtttcctgtttttaggaaaatcataccaaaatatatttgtgatcacagtaaatcacggaatagttatgaccaagattttcaaagtaatacttagaatcctattaaataaacgaaattttaggaagaaataatcaagattttaggaaacgatttgagcaaggatttagaagatttgaatctttaattaaatattttcattcctaaataattaatgctagtggcataatattgtaaataagttcaagtacatgattaatttgttaaaatggttgaaaaatatatatatgtagattttttcaaaaggtatactaattattttcatattttcaagaaaatataagaaatggtgtgtacatatatggatgaagaaatttaagtagataatacaaaaatgtcaaaaaaagggaccacacaatttgattataaaacctacctctctaatcacatcccaaaatggagaactttgcctcctgacaacatttcagaaaataatcgaatccaaaaaaaacactcaat

SEQ ID NO: 4199 - DNA, 899 bp, Arabidopsis thaliana
aacaaacaaaaaacaaaaatttacttgggagtcgaagaagtcaaatatctagaagaatacttcttcttacaaaattataaggaaaatttcccctactgcttcgagaaatacctttttccccattcacgttatgttatgcaacgtgtgaggataacgagcggacaacacagcccttatccttattttattggtcaaccaaccccaaaacagattttaagacggagtgtatttcttttgtcaactgtttacatgggttaaataaaacagtttcactaaaacttattaaattatcatgtcatattgtcatgtatataagctatagcatatatacggatggaatatcgattaaaccattttctttttcaccattggaccataatcagataatatacatagattgggaaccccaaatattttcacattttgacatatttagtagcgacattaaactacttcgtgaaaatacataggatattatgtcaaattgtcaacgaaactttttatatttaataagaaaacgaaattaaataataattaacagaaaatactcacaagtgactttcaatgattttgtctctaacgttttcaatgtttattttttggtctctgactcttcaaggaaactggtaaaaccggtgtcccggtagtcatcactcacatctcgtccaccacgtgtcactcttacacgttcataagttttcccacctttctacgtccgattctgtatttatataccctaaacccatcgtcttctatacatgctcttatttcacaatcccaccaaaacaaatctcaagaacatttcaagattcagaaaaaagaaactcgcaaacttttttcttttgtttctgtcaacgttcaaataatcaagcgattgttttttttaacctagaaaaatt

SEQ ID NO: 4200 - DNA, 2000 bp, Arabidopsis thaliana
tgaatcttaatattttgatcatatcaattactgaaaaacgcgttaacggcatcacctaagcgtggcttttttgggggtcaatgtacttctagttgacgatctagccatgtcaacgcttatgtcaacggctgttttggctagtttatggaatttcaaataattctgtatttgaaatgttcataattcattcacctaattagaccaagataatgtcatataggtaaaaatctaattatagttttaattataactagatttggaagtttttatctttactgttattctatattttagatgttatgaacaaaaatttggtgaattatccaattaaattctcttattgtatataaaaatacatagtaatctgaaaaacatatattttcatttgaaaacactttaaaatatttaaaccctggtatgttttgcaaaaaaaaatataaaataagatactgatttaaaacaaatcaccaaatcttcattaccaaaacataaaaatgtattcatcagatttaaaataaagttgcaacacatgcagttaatataatctcatatgatctctccaatactagattccatcgttgatataaaccggtacttgttcttcagcaaagaaaaactgagaatactgctaatggtatacccaatatcacaacatgttaccaactagaaccagttttaatacaacgatccttactttaagttacataaacaaaaaattaatacactgaaattatttaatctctccactatatccgacttttccaatatgagaggaagctaattaaaatacatgtagaggtttagtttgatcgagtaatatattcttctatattattacaagctaattttagtttgtacgaaatgatccaaacagcaattaaataacgaactaatatatgacacaacacaacacaacacaagtgtctttatttttgattttaattagttaactaaataactaactctagcgtggttaatgaatagcacttataaactccgagcacgaatcttcctggaagtttcactgctgcttcgtcaatactcattgcctttatattttcctcattcactctcttcccattctcatctctctctctctacctttctctcacacaaagagttttttcttttaagacaaaaactctttcaaggttttaaatctttgaaaaaattctctaaacctaaaagtgatcaatgaagattcggaacagccctagttttcatgggggtagtggttacagtgtctttagagctcgtaacttaacattcaagaagtgagttcttgatcttataccgaacaaatccttcattatttttttccggtttattttcggataagttttctaattttctagtttcattttctcatttaaaccacagagttgtgaagaaagtgatgagagaccagtcaaataatcaattcatgattcagatggagaacatgataagaagaattgtgagtttcttttctttctaattttccaatcgtctttacttaacaacttactctgcttaatcttaattaatcacggattgtttttaattaacatgttcctaatattgagccaccaagtttgaccgactacttctcttcttgttttaaactttgtgggctcctcgatctacaatggtccctaagtctagtaactatatagtatataacaaaatagtcacaagtctagtaattatagtatatatcaaattatgaaagtataacgaaatcattaatatgtttcggtggacttgtgactaatacaatttgtaccgttttaacggttaccaatcatgaaaaaattatgaaaactttgatttgcccatgtcttatgattacttaccgctaaatatttgtgagctgtttatgttacgtaaccataccatatgtttaataatattcgttgttacatgcaaattagttaatgatattctcaactcttttggtttaggtccgagaggagatacagcgtagtcttcaaccttttctctcttcatcatgcgtctca

SEQ ID NO: 4201 - DNA, 2000 bp, Arabidopsis thaliana
caacacctttcgtaactaaaatggttcaaaatttaaagcggatatacaaaatttacttgaaattaaaatgtataactaaacgagaaaaataagaaaaacaaattgcttattgctcacgaactccgttagtagacaacatacatcttcaccgattcagaacagtttgtggcaaatgctattgtcatcttttgttgatcgatcagacagtatataactgatcaaatgagtgcagtctaattcagattatatcggagagaggcttcttcgtttgttttgagcttctataatggatcacatatcttcaaagcaaaaccatttcaaacatgcaaataagtttgtgttttttttccaagaggcatctactagcatatatatagaaacattatatgctctaattagttatttcgttgtttgcttcgcagttcaatccgaactaaaaccaaaaatatcaatttggtcagtttggtttgttctggttttacctaatgctgagggctactggctaggtacacttcctcaaaaatttctattttatgaattaaaaagtatggactgtatggttgaccaaatcagaggcttctgtgagggaaaaaataatcacataattaatatctatatatatggtaacagcatcataaaacaaaaccaagtttcttatcattaacgaatctactcttctcacaattccttgtttagttatttctcaactatggattcttcccccgttcaaccaggaccaggtacgttcaagctaattggtacctgatgagttaagccaaaatagtttgtatattgcttttgattatttaagattcatgtaattaccttatatgaaattaatttatcttcttcgtcatttattcagttcatggacaggatgacaaacccaaaacggtatataacctatcacatacttatgaactgttaggatccagcaactatttgctggtttttagaaagatctgagaggaaagactaatcaatttcttgattattttccttcatcagattaacaccagcaatatcaaaggggcaaatattaagaccagcaatatcaaagggacacaagacaaaggcaccaaataaatcaagcacggaactcgaaagatgatgcatgttttcttgtctaattattgtggattgaatcatttggattgggttaccaaaaaaaagagagaataatttgaattgacgttggaggaatctttcttcctcttatcgttttcttcatatttctactttttatcattttatgtaacttttgtaccagtatctattcaaatgccattgaaataaaaatatggtttcgtattccaatgttgttttactcacatatatattaagaagactttttgcccaaaaaaaaatatattaagaagacttttgttttattctaatttttttttaacatatgtagctataaagaaaaactacaaaaacttgggaaactatataaacttataggattgaatgaattttcatttattcgatgagaatcatagtatattttctttctgtttattttattaatcataatttatttaaaatagtttgacatgaagtaaacttatgagattactattaattattaaagttttttaaaattaatttagtgaaacgattgacaacgcaccctcttatgcaagtataatatataatagataaaaaaatataaaattataaatagcgcactctcttgtgtaatttttatttttctaatcccaaattgccattttttaattcgaaattctctctttgttatcagatccacatccttctccaatttgtaatttttttaaaaaaaagacttaaaaatcctacttccatagctcatttacatccgtatcacagtaagcttgtgtttccttaattttgtgtcttaaatctcataagcataaagacgaacttttacaacaatttcttttttttcttcggtatctctttgatttttttttaactattattgatgttgaaaatataaagctcataagcaattggag

SEQ ID NO: 4202 - DNA, 1037 bp, Arabidopsis thaliana
tgttttttggaaacagagagaaaactcaaaagcccatgaagcaagctctgagataaaattacaaacagaagaatgctaaagtgggacttttagatggttggagagaattatgcatgtgtgtggcaatgattagcgtagtgtggtggtgacaacaaacaaaggtggaggaagatagaaagtcgatagataccttacctcgaaaattcgtctctctctttgattatttttgtatatataaatagaaaaaagtagtagtaaataagaaaattggatacagacacagatatgtcgtgaaaagggcactaaaatattggatggtgcatgtgaatcgtcaaaaagtggcaaggagaaagtgaaagtcttcacgaattatattttggtttatatataaaagaagaagaaagaagaagaaagaagaagaaagaagatggatgatacacaatcggtcacggactcacgggtaggaaggattgtgaggcgttacaatctcgtcagacttccaagtcttaatctgatgggcctttaaatagcctactgtactgagttgtttgttgtgtttttgttttgttttttaatgccaaactaaggtatatgtccgtattttattgctggcaacatatactctgtccgtttgtgttttttgttttttatttcatttttcctcaaaattacttttgttcttttaaaaatattaaatggcataaatagttaaactatcaaccagtaaattatatatgatacaataatgttttttgttttgtttaattcattggaccagatggattattcagcttacatttttcaatattgaattgtaattttttagagctataatctttaaaaaagaataaaaaaatcaaaaaagcttttgctcatctttggaataaacgaacttgctattaagaccaagcccaataaacaataaaagcccgaaaaaatagagctgggccggtaattaggattatgatgatggtatataactcactatcaactatcatgagttcatgaccatcatggtttatatctaatgtcatatg

SEQ ID NO: 4203 - DNA, 2000 bp, Arabidopsis thaliana
ttctttttcaaataccatacaaagtaaaaataaaataatctttactgatcctagctcttgatggctgctggaattaaacattcacgaaccctttaattccgctgtgaactcgacccgatatatatatatatatatatatatatatatattttacctactttgtagagatatatccatatacttaatcattttgtacatcctatatagcaatttttttcaacaatttgtttttctgccaattagtagtttttgtgatggttaccaacttcttgtgatggcttttaagatattgcgaacgaatttgttgtaacataaattttatgtctacttatcaaattgtcatatttcacattattttactgacttttagcaactactttgaaaattccctctccatatatataataatgcgatagagtatggaagtactggcaatagtcgtagctcagttgcaaacaatttgcgatgaattttttgcaacaatattttcgccagatactaatgaaacattatatttagttgtgaatttgtgactagctaaaaaatgagatgaaaccattgctaattcatgatatactggtattctcgtcccaataatatgcgacgacttcttttacagtcttttccatcacatagatgtttttgtacttgtaaagatgtttctattttcataatacactacagtcttttacagccttttccatcacatagatggttttttgtacttaaatacttttttgttaaagacgcttgagtccgtgactcgtgagtacggataccccacaaggccacaacagccgcaaacgaatccaaaatcagtatattcgaaatgcattacgtacttaccttttcgaacgaatctaaaacgtgtccagtttgagattgcatggctcatatcgttgttgtacatgcatgtacattgtttatgtaaaatacaataacttttaattatatacgtatatataatcatttttaaaatgtctattgtagcttcaattcaaatggttcgggagaaaaaatactctctaaacccatattaaaacttgcaaataattaatttagtatcttctaataataattaaatatatatacatcaaaactatcatttttatctggtaatgtttttcttatctggtaactataattaaaagttatcgaacaaactttcaaaatcattaatttttaatttataaattagaataaataaggataaatattttatatgatattctatcatctccatttagagctatgtgaatagctgttgcgcatttgtgaccaaaaggcgagagagctaaagatctcgttatggccatctattggtttactaaacgctaacattatctatgattttttttttcctttgtaaacaatatatcaaactttttttgttgtgaaaattcaggaggtggctcgtattattatattttaataaatctattctattttttctcataaactaggtagacttttattatttttattattattttctctatcattttcaattatatttaatattattgcgagctagaccctaccatctcgtgtcttatcgttcaaatactatagaataataatattaacaatatgtcaacggttttttggtaaggacgagttaagaagaagaagtcagtctccaagaatttgactcagaacaataccaaaactgctttaattcgtcaaaatatcaattctggactattcatttcaacgtctcctccaaaaacgtatgtatataaatacctacacccaccaacaccacaacttaccaagtctccaaacatagttcctcgcatttacatatatacatataataatatctctagaattttcaagagcatcaagatccatcaagatccaccaggtatatatatacgtgcttcgtacatacatacatctcctgagtttccgttctttgataagttctctatatttgctaattgattattgatgcatatgtacgtgacaatgtctcattaacagtgtaacggagaaga

SEQ ID NO: 4204 - DNA, 2000 bp, Arabidopsis thaliana
gcttgacttttacaaaagtggtttaaattttcttgagttacgcaaacgggccaattcctttggcattgcatgaattttcttcacgcgttatactttcatatcaaataaaacgtcgccgttcagagatacactttttattcagtccttggacttggatatggaacacggtttttagttgatcagaagtcaaactcattgtcctatcttgccgaatttagaggatttatttaaaaaatattaaataaataacgcatgataatgataatttataaaaagtataaccaaaaaaatatctcttaaagaaaagaaagaaaacaaaatgtagttttgagtttattggttatctggatttcggaagatatatatgattcataattttttaggagttaaatttattttttaagactttaaaagaaaagaaaaaagttagtagacattgtttcccataaaaaaacaccaggtctcttaagtctcaagtctaaaccatttttccttttctggtcagataattctatcacacatgcttgaatttgaatagaaagacaacaaaagatggtttaaaaaaaaaaaaaaaaaaaaaaaaagacaacaaaagacaacactgggaacatatttacccaaaattcgataatggacaagctacattcaatctatgcttatgttttcgttgcatgcgaatgcatgttgtattacgtttatgagggttgtgctctacgatgtatactcttcacatgacaatatgtacactaatctacattgataatacatatatttgttaagttcaaatagcattatcacaaatgattaagctatatgtatgttgtggtgaattttccataaataatttgtcatctgtcaataaaattttaatgtatattctataacggaattacggtcagatacatgtgtaggtaatgaattaagtaagatattaatatctgtcgacaaataaaagcatcaatatgtatgtacattctcttaaaactgattcgatttcattgtgtcactgtgtatattgtatagaaacatatccaaatacgtatctcatgcctgtcctctaacttaaaaacaaaagaaaaaattatcataccagccaatttaatgcacaagattaactaattgatcaataattggatacgttacaactctataaaatcatatccattacgctttgggcaatggcaaattggcaatggaagtaaaatcaaaagttaaacaaatgaattaccatttgaaacactccaaattggtattcgtgtccaaaataatttttccaaatgtcccatcattctaaagtttttcaccttatgcatggaaccttcctagtatatatacagttctaaaacgaattttatttgcaatggtctatcagagattataatgtcaagatcttgactttttgctgatgtgtagtgtaatgtgctgttttaccaacatgttatatatataatcgaattttttcttgaaatgcctaacgttggttgacaattttatattacgaaaacctttccctgattatgcatattcaaattgcggtaacagaagtttggtcaaaatttgactttcatgtaaaaaaaaaaaaactcaattgaccttaaacttaaattaaacacccatttatatataattatcacggatggaatttactccttaattacagtgattatttatctaatttttggtgagagacagatctatgcgtgtgaatattatcacaatatggtatatatgttgaattttttgacaccgccacaattatatatgtagtatgtacacacacattatcattgacttgaatttgtatgtatattcaaattcaacgttctcaaaaccctatatatataatccaaaacatttagcaaaatatctccaaaccaaaacacaattaagctaaaaaaaaaaccaaaggatgtctcagaaactcatgttcttgttcacccttgcctgcctctcctcgttaccatctccttttatctccgcccaaataccggccattggaa

SEQ ID NO: 4205 - DNA, 1410 bp, Arabidopsis thaliana
tgtttgctttttaccagtgagagagagagacgacgacgaagtgagcaaatgggtttaggagctgtgttacagaaatggggtttctctaataaaacgacgtcgtcgtttctagattattcaatgggctttaaatgttatgggctttaacttagctcaacccattataactgcatttgatttgaacaaagggcaaaagtcagatgcttaattcaacggatattccatttgttgtttttgtaaatgaccaatttgctcttaatgtataccacaaaggctttagtggaatatattatggtaagggtgaagtcgtctgaacaaaaaatatgactccatttaagtagctcgtcttgttctctcgacaaagaaaaaaaattacatttctcagacgttgcagtacctaaaatattttttcatcatgccattaccctatcatttgttttattatttgtgttgtgttctctcatggagcttctactatttcactttgtcttccatgtacaaggtaattgtctgagttattcgaaacacaatacatcggtttgagcatttttgtgtacttcattatttatggaccataacttgaggtttcagtttgtttccgagcatctttttgtaatgggcccatgagagaactgatactgggcttgatcagattgatgtccattatttgtgctttattgggctccactctttctcactctcacattttttacaaggttttctcttcttttttttacacctattttcacttttctatgtgttttgttttacacctattattatatttttctttgcctattatcgttattttctttgccgactatcatttttttctagacgttatatactgttttagaatattacgtttattataatattaagaatttgtttgattgtgtccttttttgacgcagacagaaagaacgtgacgcatgtacgaatggctgaatcttcctccacgtgtcctgcaattaaaaaaattagatcgtaccgcatcatgcgtcagccgcgtgacacctgatcataacctagttacttagctcagacatcgccacgtatacgtccctcatgacgggaaacgttaactctgacggcgtcacatgtcgaccattcgttttgtgaaatgtattttgtgttcccatttggctttttgcctttttccccaaggtttggctctaattaagtaaacgaacctgtagcttcggaagttcgtatccgaaccaaccaacggctcagattagtttcatattttcaacggctgagattagagtttcgatttctttcttctattttaggcttcgagatcttttcttctcaaaaggtaaaaactttgggaagcagctaaaatactgtgttctttgtttcttccatcgaaatcgaaaaaagctaagatctttgcgttttgaaacg

SEQ ID NO: 4206 - DNA, 1215 bp, Arabidopsis thaliana
ttgatttttgtgttttatcgaaatgatttgtaagttttaagctgtaaaataatatgtttgtttattttttgtgtctatgtcactatgtgggtatgagagcaccattaattattggtagttgcttaggttaattcttagaaaagtttggttataaatttaatgtttttaatcatatatttgttaaaaaagtctcttatataagagacaaattgaagtattcttagttttcgtttcaaaaaattaaaaatcaattcataaaaaattctaagaactaagttaacagtaatctaagacactaacaataatgatgctttgatgttcttataaactgatatgatcttaataaagtgaaccaaaactaagacgaaattttatattttaaatcatttgtgtcatattggtgacctatagattggttcaatgatttttgaataatttttcataattgcgatgtaattagtgttgcttgaaattattgtcagcttcttatatgagttttttaattggaccccaacgcatctattttattatccaagtttatttggcgttgaaactaagcttgcacttttctttatcttctttctaccttccgaccataatttcatttatcagaaaaagacagatgcactttaacaaacaaattttaatgttgccaaattatgcattttttttaccattaaattttcatgttttacttattgttcctgttgattttgcttcgattgtaaaagaatatttgcttagatctacgagactgaaacgagttccgttgtaattcgttttatattttttaataataaattccggtagaactttctccgtctatttttcatttttcttatcaaaaaaaaaaaaaacaaattttaatttttattctatttttcaaataatcaagttttcaaagaaaaatggaaacttgaattttagtaatttcaaaattcattagacggttagagagtcttcatcattgtttaaacatttccttaatttgacatttagccatcaaaacggaaatttagttggaaaataaagtaaatgacgaagttacgtaaatgcccccggttctttcatatttcttcaaaacagtttttggccaatggagaaagaaaaattgagagtcgccacagctatcactctgctctgtcactttgtcttttactcagagaatcagagacagagagagaaagagagagagagagagcgaggggaagggaa

SEQ ID NO: 4207 - DNA, 1288 bp, Arabidopsis thaliana
acttagggttgaatgaccttataaaaaaagagagaaaataacatgtgtgatgtggtgtgtgtgtatgtgtgtatacggtcatacgtctaagagtgacatagtgagagacatatgactctcactaagaaaaaacaatgatatgaatatataaatattgtagattagggttttcgtataaaatatttaatccaattggctttgatatagttttgcgtttttcattgtgaatatcacatctgtagatcattcatggtgtatagtatcacttaattggatctagtaatatcatatcatctaacatatgtttgcgtaatagattgaggtcttttaaatacactctttcatttgatcagattctagaattttttttaaatagttttaatgcaatattttggatatatgctaattaattaaaactaaatgggccgggctacttgaccctaaccataagccaagcccatagaaggcgtaacccgtaattcagaagccctaggtttcagagaaagtataaataccttatttcagttttcattttaccccaaacattaatatctctactcatatcgccgacttaaaggtacataaagtttctcttgattctttcgatcttgcttcaggaatcaggacactggttcatctcttacctcatttgattttcatcattaggtttcaatttatgtgcgctttgtctgttaaattttcgtaatttgccttggttgatcatagtttcacattctctagctgcttaagttttgtagtatgttgtaaaaatgtgtgttttgattatgatatactctcaaggtagttctggtttatgattcaaaatgagaaccctcggagatactttataaaatcaaggccggagtctctgaatcagctcttttgctagaatccagatttatctgattttttagtgagaaacactcttatagagcttgagatttggtttatcttaaatgataccatcggcctttgatcgagggaacatttcgtttcatttttccagaattccttaagagtatatcttctattgtcataatttctctgcaaagtcctgatttttgtatatacctgattcgattgattctattagattgttataggggtttctgctaatagtttaaatatgtagtctggtaatagttggtgttcattgatatgagatttttgcttgagtacatgggacctttttgttcttgcttggttttgtcattggatttgttagatgttatctgctgtgtttataagtttttatcttattttctagtatttgtttctggttgaaaga

SEQ ID NO: 4208 - DNA, 650 bp, Arabidopsis thaliana
cgtaattttctagatccgtcttgggagctcagactgtatcagtgatgatgatgatgatgaagaagagaacgaattttgaaattggcggttttgaatttttaagaaattaaaaaatatcccccgtcgatttcaagagggagatggagataccaaagcaactctcgccacttgtcgtcttttaattttaattgagtacgttatgccgttttaaatgttcaaaacagcacacagttgatagctgaattgattttttcttttgccgttttgttatatttaaacaacacacagtgcatttgccaaataactacatgatgggccaataaacgtggaccgactaaaactaaataatagaagatacatcgataggcttctctaaagatcggataaaagataatgtcgcatagccacgtagagagcaactggctgagacgtggcaggacgaaacggacgcatcgtacgtgtcagaatcctacagaagtaaagagacagaagccagagagaggtggttcggccatatgtcatcgttctctctataaactttatggaactttgttctgattttctcagagacacgaaaagaaagaaaacaacactagaacaaagagggtttgattgattcacttgaaaaagagaaaacacagctttggaaa

SEQ ID NO: 4209 - DNA, 2000 bp, Arabidopsis thaliana
taatcggtttaaactttctttttttttgactaaacaaaaatttataatcggctatctagaatcataaattttttaagtaaatcgaaagtgaatttatttatatcagaatttttgttttatataatatatggatacattttttgtcataatggatagagacactgccatcaaatatatggatgctaaattgttcatttttcaagaaaaacttggcacctaccattagataaaccaaaagttgaattgaaaggtttttagtttttagttattctcacttttgcaattggggtttcatgcttacataagcaatgacatcaatagctataatttgatggcagtgtctctcttctccgaagatgacaagaatatatgaacaggtatatcaagtcaagtctcttttgttttcgatataaacaacatatcatcaatcattactccgaatgtatatttaaagttatggtaaattattgtcacattatacaactctcgatccttatatctaaatacgttaaaaatgtataaaagacaaaagttaacctatttgaaaagattattgtcacatttcacctcgaatatttaatgtcaaaagattttatttgaaaacttcgaaaaatatatgtgtttaatcggagacgaaaaacgaatcacattggttatgacgtaactaaaaggatacatcataaatgatttaacatagagaatttcattttgaagaccatattattgataccgatatatgcatagcatcctctaaatgctaatgaaactcaggtatctagacgatgaaaaaacaaaataaaaaacaaaaaaaaacgatatgtcatttttcgtagtttggacgtgcagacttggcatgcaatacggaaatcacccgaacttccatctacattttggtaaaaaaaataaaaaaagtgttacctaatttctttttgcattttttagttttatttttgtaactcgttaagtcattattaaattgcacattcatttggatggacatacattgtgggcagtcactgttttgttgtcagagtcattgtattgatatatagagcaaacctaacgaatacaaaaagcatacggcacatggcatgacattgatatatataccttcacaaaccaaactcacatccaaaatacttctcttctttctttagtttcttgtgaaagatgattacttacatgggtctgagccacacgattgtcttactttatttatcccgtcaagaatgtttggaacttaaaaatgttggttcttaatgtaataaatctctaaacgttacgagagaaggacatatattaccatgaaaagactatgattaattttattttattttaattcattttccagatgcttcgaaaacaaggtaccatttgaaaatacaagtctaaggatggatgttgctaaaccattatttatcctcgtgagtgtcttaagatataacatatagtcaaaacatcatctatatatataattaaaaagaaagtttccttccaacgattctaaaaatatatttaatggtaagataaactttagaagatatatgcaatagatggtataatatattgacaaactcatccaatagcataaatccaaatcttagcttattttaattttatgtactctgataagtgataaatggtttctttagtcgacatctgcttgataaaaaacaaaaataacccatcgaggaggaggaatctagctggcggatatattgaaccctatatctaaaatagtatccaccactaattttaagaatttacgatccttaggccatttgtatgaataccttataattaaccaaatcactaacccaccaaccccttttaacttttctatttggtaaagagacatatagaaacaaatcttttatattaaagttgcctataactactattttctacgttgcatacttgcatatatccgataaatacttccgtcataacagagtaagagtttgtatgtaacaaatttcaacaaaaagaagagaaaaaca

SEQ ID NO: 4210 - DNA, 2000 bp, Arabidopsis thaliana
taaaccggagatacttccaaaactatcccactaattgccggattccgcagtctgttatcgactcttcttattatgacttcgctcaaagtcagcttccaaaacattatcaatttcgaatgtatttatttatctcttaaaaccacaagccctaagtcttttgtcgaatgtccatacatcacggacggatgtgagacgtttttttaacaaacaaaaaaaataaaaatgtgagacgtctagtcgtatatacaagaaaattatactgtggattacccttttagaagaaaaatatgaaaacaatattcattaataaagataattgtataattagaaacaacaatatgataggaatgtggtacaatttcatttgtaatacagtggtacataggctgtaagtacatgtcatactttgaaaatagttcgttctgcatgcattcaaaatttgaatatgattacattatttttttaatacatgtaaacgcaaatgctaaacaatatccttgtttgacacagtcacggtcataatctcaatcttagttcattggttgaagaactaatataataaaaacataaatcgagcttttgacaataacaaaaaaaaatatttagagaggcgtagacaaataaagctcataatatcctcaaggaaagatgatcgtttagatcttatcttataaagtcagcggtcacaatttgaggaatataacaatgatactatatgagactgatacaaaaaaaaatatatatatataattttcatctatctcaattaaggttttttttcgtgtaatctacatatatttgaagtagtactagtctttggagataatgtgttttgtctccaagataggtttctgaatagtacaatttatcgcttagcacaagtcgttagaagaacaaatacatctgtctccatataagctagggaccttggtttgtagaaacttcttaaatgaactgcctcggccctttcctttaaccattaatcttttacgttatttattagtctctcatttgatcattgcacaataaataacacattgaaaaaatgtggtctggtgatatagctaataaggttcatggctttctatagtttcaaatatataagaactgtacgtgaatcacaagggaaaaactttgaattataatcattagcaatagtttattaagaagttttttattaaaaaaaaagagtgtattatcattttgtaaattacaaaactgtattcgccgtgaaaatatagtaagagtttggagaaacataattaacctgatcttcttctttttttacagaagaatcttgaaccaaaattcagagtaattaatttctaaagtttgtggaagaaccagattgcttcatgattccaatcacaagttaattcatttactaccagtagttttatagtgagaatttataaacctttggatatttccattattaaaatccacttggcagacttttgcactttgtaaattaaagaagaatttgatgttcgttttaatcctctaatattgagatctacctaccaaaaaatggatgtatatacaaatttcctaataacaaaatagtataatcctcatttttaattatatatttgctatacatcaattaggcatgaacctaaattcaaaactcctatacgtaaacgatatttccatcattcgttacataattcaatcaatttcacaccaagtaactatcaaaacgaaaaaaaaaaaaaaaagtatcaaaacgaacaaatccaaaagaaaatgcttttaaagtcaaccagtcgaccagctcacaacgcactgaccaacaccacgcgcttttgaatctcccacaaacggtgtcgtttttcatctatcccccacaaacaccaaagccggttttgttgactcacacgtcattctttgactaatcaatctcctctataaatagtactctataacgaactaactctactcactataacttaaacacacacttcatcttctctaaaaccctaaaatttaaacacaag

SEQ ID NO: 4211 - DNA, 2000 bp, Arabidopsis thaliana
ttatggcctgtctttctgtagatttttgttaagaaacctttcaataaattcgatttcttgtgttttaggttacaactctcgacccttatatatggctgatgagcttcaaaatagagtaggaccctaatacacgttttagaccgttattaacttaccagccaatttagcttgatctttttccgtttttgtattctttgtaatttttgacgcaacttcaatatttcactctttgaattatgttgttcattagttgaactattttacatagataaaattaataatattttaagatagaaaaatttatagcaaataatttatgtgtccaaacctagaaacattagataaaatgaaatagaatgagtaataaacaaaaacccaaaacaagaaaactatgttagttttagaattgaactaacacgttaacaaactttattttaaaatcaagaaactttttttttaaaatcactgtctttaaaaatcaacagattttatttgaacttatcactgtctttgtcaaaaaaaattgatgtaaactttattttaaagtcaacaaacttttttgtaactttaaaaacaaaatatatttttcttttaaccaaacagtgtattcgcatggaaaattattctaattatacaaaatactatataggaacggaggagaacacaatttaatggtcagatctagatctcgtcggtcatccacctttcagttttcacgagtgtgtcgaacgaacgatattaattaaaaactaatcaataaactgaataagtacaagttgcatggttaatgaagtaaatcaccgatttgaagtcattaaaccgaccgacacaatgaataaaaacgcgttcacggattttattccgtgttgatgggcagtgacactgacttctcccattaggcaactgtaattttttctcgtcactatttttcatagcaaatctaaaataagttgcaagaaattaatttgatatacaaaaaaaaagaaagataaacaccatgtgggggttgttgttaatggtggaattgaaaacgcattaagtggaaatctaaatacaaagatcatgaaaaatctaataaaatatttgtaagttgtaacaatctatatgtatatctttgctccaaatattaattactagacaaataaaaataagggaaacaaaaagatttaacagcaagtcgacagtgtggacatggaaagagacctttacaacgaaaacaatgtacttatcttccaattataggaataaacatttcgccagtgaaaaaaggtctcattccttccttacttgtggagatggagatctgaatctctaaagtttcgatttttatttattcacttttatgcccaaaaagaaaaatcgttactttaaagccaaaaagaagaatacacaaacttcattcactctctcccattctcggatctctctcagtgcacagtggttgtcactcttctcctttggtcggtgagttttcaatcttttttcctttcttctgcgattttcattcgttgagattcgtattttgcttccttctcattctctgagatattcgttaatcaatgagcggtttttttacttttcctgggaaattgagtgagacttttcattaaaagctctcccgataaaatggaaactctactctcagatctactactactttctatttaattgcataaagatccaatctttgacaaaaaaaataattgtcggtggccatttttataacacttgtgttacttacttggtttacacttaacttgggttctgaatcaagagtgagtggtttctgacccaataaacacggatctgactctaccaagtctgaatttatcatgttctgtttattttaagtgccagtggctttttaccaaactctatgcttaaagtcatattctttataagtgttctgttcttgatttctgcagaaactctttcttggaaagagcattttgttatcaagactctgaagagctcttttgggaggatagtaaggttggatg

SEQ ID NO: 4212 - DNA, 2000 bp, Arabidopsis thaliana
tgtataaataggtggacacatatatgtatataaactaaatttggcatttcctatcatatgatatgataagcttgattggcatgtgatgtggattggaccacacaaacacacacacacagaagatgtccataggccataggcggtccattattattggtaagaaatgattaaattaagtatgcaaacaacttgacattgaaaatgatcttctgaaagtgatatttcaatgttttcacacaatcttgcccgtaaatggttgcatttaattgttactagatagaaaacggaaaaaaagaacaatttttttttttgtgtttttgtttttaatctctttctaattatgtttttgtgaataactgtgtgtttgattaatatattgttttcgagattcatcatataatatttgttacactctatagatgtgatagagttatctactacaccaataagatataagaaggccacattttgattgtaattgtatatatgaatatctgtggacaaaaaggtaacacttcacataattccaaaggctacgtaacatcagattggttgagcttccacatgggaattcggcaaatctgtaatcttctgtatatgccaaatatgtaattcttagacttaggaaaaaatggtcatctcttcaataataatacttctaattaaatggtcctcactaaaacaatgtttacttaataaaacgtataaacaaatagattttgttacatataaaagtataacctaaaatgcatgcagcaaatttctggattgttagcatatagctcagaacaatcggaaacaagatgtgctgccacctgaaacaaacatactaatatatgattattaagttgacatgacctaaggggaatctcgtgagattcgttttttgacaacttagctttggatccagaatcaaacatagcccacacaaatgaaaataggataacatggattccacaaactcttcacactttttatattatatatagtacttgtgattttataatataaaataaactatatcaatgatattagctagatatttaattcgcgttgaatgtggatactacaagagtttgatagattaaattgattcaagcaaatattttagtgggaatttgtaaaacactacatcttcgttatcgacttgggtatgagactaagagacaatatatatatattctattaaaaaaactcactgttacatgcgataaatggatgaataattcttgcttaattaagtttgagtatattactttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaacc

SEQ ID NO: 4213 - DNA, 2000 bp, Arabidopsis thaliana
tattttttgcgagggatcattaattctgatgaggaggacaaagcttcaacaagcgaacaacaatatccactacttagagagctaaagcataaacatgaattgcaatttccgccaggttagttttcaatcctttccaaaaatcaactactatcaataataattgaagcactttttagtcgaaatactcatcactcgaaacactttctagtgtaaactttttaattctactttaataacacactcataaacactatatcatttagtagtaaaacactcagtaactaaaaaatattttcttaaaaaaagatatgatgcggaacttttaattaaaactcacaactaaaaaattaaaatagttgaaacatacttagtaaacaccaaattattttcaacaaaaaatagtcaaagtcgtagcactgaaccattcaaccaaaaaaaaacacatttaacaagatacacacacgactaataaatgtgtattttcttacgtctttaaaattacattaacacttaattaattcaacaaaatccctttagccaaaatttagtcgaagcacttactcaaaaaacttatatctaaatccgaacacacgtaaaacactagatcaatttacttaaaagtcgaaacatatatttccaagcatacttctaaacaaagcatacttagtgaagtacattagttatactgttgaacacaatattaaatcacgaacacgtactcctaaactagtcaggcaaattactcctaacattttagtcaaaacatagttattcgtaacacttgaaaacacttccgcaattccgcatttaaaggcaagtgcaaaaatcacactttatttaaaaaaagcttatataaaaaccgttttaggcgaagtatgaatattacttgaacaattattgtttttacttcacatttcgtcgaagcgtctgttagtcgaagccaagcacaagttgaaccactgttagtcgtatcgctgttagtcgttagtcaaaacacttttttatgtcatacattttgtacgttgttattaaatgttaacttgatcgggaaaagaccactctgttgcaggtcgcacacctttaacagtgatctaatatatcaaagacaaaaaaaaggtggattgagattaatcataaaaggaaacaaatactttaacaacttctcaaaaaaattggtgatcaaactcagaaaactaaaaattggaacatagcaactgaagaaaatgaaaatgaggatctgtttcgcatccatatttcgcaaactcattaaaacgttaattaattttaaaataaccaagtgtagataacgcagcttatcggatccgttggtataacgttgtatggtcctcagtttggaaggagtggcgattttccgaaaatggattgatataaggcaaacagattggttcagagtaatttcaaaaaaatcaatgaaacggtatatgaaataatgtacttaaaatattatatcaaataggctatctctatgctcacatcacatgcgtcgaataaacaattaaaacaaaaatccaacgggacgaccaatagcataattccggtggctcgtaattaaaaattggtccacattatatcaaagtgctcacgtaccctttcaaaattccaattccaactaatgttgctgtggtgctacagaaataaataaaaaactatagttgaaaactgacaaaacaagtataattaatattgactcgctttatacaagaaacatgttactttgtacaaaacaagtataattaatattgactaaaatgaaaattatcactttatacctgttaagaatcgatagattatcatacaagttgtttcaaattattatacaagtttgtttcacttcactttacaccgaatagcattgataaattaatatacacctgctaaagtgacgaggtttcaaaagcatatcattgcatcctataaaaagaagctcactcagtatactaaaacacaccaacattcatcaaaaaaacacataacaaaaa

SEQ ID NO: 4214 - DNA, 2000 bp, Arabidopsis thaliana
ttttttacccaaacataataattaattattgaacaaaaggtacacagtacttaacactaatcttcatttttcttcattttgtgagctgatttggtctaattaaatcgatggcataaaagccaaaaccagagaaacattgtttatgaatagaaatttttagaggtaaaaatttagcatttggaaccaaagagtcggttctaatataatgtataaagaacgaaaaataaacgatagaaatattaactgaacatttagtatgacggtttgggactttggggtgacaaattgttgtactatattgagctgcccataagcatttgtatttgtgaaacattgcatattaattggagctgaagtatatacatatgcatagctatgagttaatttttctacctcgtctcgagacaatgcattttgaggtgatttggttcccaaatgatgccgctctaaaaaggctaattaagaagtcaaacttattgttgttttgttgatgcctcacgggaatcaccagatatgaaagctaaaatctgatgataaatgcataacaaacaaggccatcaaattattaaaggtagttcttcaatagaacccacttcaagcaaaaccagtagctttactaatggaagttcaacaagccagaaacttgggttattatgaggtaacgtttgttggagatggcaaagcttaatttgtatgattgtcaccagtcaagaaaaacacagggctaactgcaaaacttctatcaaaactcttgccaaagacatcgtatctctttctagacagcatgtaattatatatatatgtacgtggaaaacaaacttagtaggagtgtgtacaatttagctaagtatgattgaatacattctacaggacatgtagtaacttggaactagttatattttctttcttgtgtaataagaagatttgaggacaaaaaaaaagatgctaaatacaagttggcacatggactcggaaaagaataataaaatgttgccaaaagtaatttaaaacaaaaatagctagccgtcgaataagacctgtgcccacacacacctggcaagccgccgggtattgggagttgggacacatgaccacaccaaagatccgatctagatcatttacattagataattatttatccatggtccgtttatttttgtaaaacaccttcaaatttctttattaacaagtggtcagaatagttcagattaatatcagaaagacaattaactataaggatagataaagttgcatgtatttgaatcatatatcaaattctatctgaatcatatatcaaattctatctataatctatgcgaatgcgacgtgagtcaataaatattaaagacaaatccaacgagacgagagaatcgactatgagcatcttccaggtggctcgtaattaaaagttgttggtcggtgggtcctcattcaaacgagtgatttattatttcgttcgattcaatacgcaactctagtaatttcaatttaactaatgctgatgcagtgtaagaaagtatagttatcaaccaacaactcgctttgtaagagaaacatatcatacttttgatgatactattttttcttttttgaatttcacaccggattcaatcggtaaagtattatagaagttcttactgaaacaacattaatttttttgtaaaatataaatctaagaagaaaaaattactagggaaattaatagcaaactgtaacggttgactggttttgctaatcgtgcacggtttagcattgagattaagataagctctttctaaaatattcgaaacatatcctttaaaaaaaaaaaaaaaaatcaaacaaaaccagcaaaagtaatagattatagcgaaacaaagaccaaaaagtcgttcaaaatactctttaaaatattataaaaccaacaaaaaaacaaagacttccttggctcctcctataaatagaagctttctctctttaccagaaacacaccaaaatccattaacacacacaaaaacaaa

SEQ ID NO: 4215 - DNA, 411 bp, Arabidopsis thaliana
tttggatttaattaaaattaataaactatgattactaatgtaacaatcattaagagtaaggacttaaaaactttaatggcccaggcccaataactatgctcaactagctgttaaatgtgtacgtacgtatatagcaaaataacagtgcacgtagaagagctcgcttttgaatgacgtggcctgttatgattggttagcttcgcgtggcgagagatttgattggtggaaacaacaaaatgacacactcgaccgggtctacgggattgaatatataatttattcagagaaaccgaaaaatacatatcactctttctccttcacgagggatttttgttccgatctacttctccggcttatcaccgatttagatctaagcctgaggtttccttttgcattttagagattccgaga

SEQ ID NO: 4216 - DNA, 1074 bp, Arabidopsis thaliana
tatcttgtttcccaagaaattctgttttctccaactggtcactgtcgtgttcatattctgtttttccttctctcttatgtctttggttcaaatctgttaaagaaaaaaacgcctgtgaataatacttaataagctcgttcgtcttcgtcaacatacaaaaatatcaactacgtagtaataccacaccttatttatttagacacatacagttcttgtttttcttttctctttgttatatatttcgatatgccctttattttttattctttttataaacatcatgaatgacaacacatgtgtgtccgtttcgctttccggccgtttttacaccgtcacaccattcacaatcccaatgttaaagacacatgaacgttgggataaatatttctttgatttaacggaaaaaaaaattgtacaatgcaatatattattataaatgtatatacaaagatatatatattatatatatatataacgacacatatatatatatatatatatatatatatatatgtcgaggtaaatttgaacgatatataaggggttggtaaaaaaaccaaaaaccaaaaagtgatttttggattttggtttatagttttcagattgtgtattaaaaaaaatgaaaaactaaaaaaggttttataaaaagtcaagtcactttaagaaaattaaaaaccaataaaacataaattttagattttctttaaaatttgacaaaactatcaaaatctaggtttcctattttttagaaaacacactttttcacaatcttggttcggtataaagtagatttttagaaaaactaaaaccaaaaacaacatcaaaatctacaaccattcaaagtatcatgtatcaatttacctactttgggtctggggtcatactcataccatatgtcttttatcatctgtcctttatttatattttcttccatcagtcagtttaaatcaatcattttcttcaactatttaagtcaatccaatcaatcatttaggaaaaatacgtatacgtttttaataccacctacaaaagaaccgtgtccaaacttttgtttcgtccaggaaagaagccgac

SEQ ID NO: 4217 - DNA, 2000 bp, Arabidopsis thaliana
atgaagtttaaagtaaagccaaaagagatacaatgtccaggtttgaagtttaaaatagagccaaaaactttgaacacgtgcgggatatcaaataatcagttatgcatagttttggatgggcttaagaaagaataaataattttgtgtcctactggactcaggatgcatgtgatgatgtgtagtgttctaatagaatttagttgcgtatccgttcgaataattattttcaacacctcctacttttgttacattgttttaaatgactattgacaaaataaaagtaaatgtaaataactaaaacagaaaagatgtgagaaaaactaggaaattcttttttttgaagaattattaaatttgctagatttggataatcgattcaacatttggaaaagaaaaaaaatatctaaggatggttgaaagatagtttatgatcaaactagccaggattttagaggggtcatcagttttctgaacatttatatgttgttttccgataatactataaatttgatcaactaattagatgacttaaaataatgtaattgggataatgtttaagaaaatattaggtaactcatataatttaagagttataatttggttataatttgcaccaaatttgaaatatatttctactataagataactagaaatagtgaagaaaaaaacaaaggaaactagaaaaaatgaaaaaatggcacatgaagtatcttttttgtttgagaaagaagttgaaagcagataaagccaaattatcttctaaacatgagatggctcgaaattatttgttgtttgggattcaagggggcatgtatcttgaatccttccaaccaacaattttctttaaccatgcttttggccaaaagattttctttaataataattaataatagcttcctaagattataggataatgatttgatattttatgtaatcatatttgcaatacctaagcatgaaaatgttttgttgagttgatccagcagttattttggaatatggcttaatcattttcacatcgatcttgttatttctgttcgtgaaatgtgaactttcgcagttatttgttttattcataagttgttttagatcaaataagtggagtccacttagaaattataagatgggaattttatttgcatatcaaaattatctataaaaattttagtcaactgatttttagttttctactaaaatcgccatcttattttcttctagattcaatttgatctgaatgtggcatgtaggttgataaaacttatcaaatagcatcaaatcagtattttctaaaactttttacatcatcataaatctttcacttataaaatataatatcttgggtacaccaaagtaatcctgatatatactacaaaatataacattttagttgttttcatatgtggttaatcttttttaggtcgtacatgattcataaaccttaccgtcataaaaagaaaaataaattatatttaaactaagaaatgtgatatgatgcaaaagtgacaaaatttcgatgaatcatgtgatgataatacgaaatgatatacctaacctacactgctcattctacatttgaagaatatatacctaaatatacataccaattctgggataattacataatatacagtttcatattagtctcacgtaattacgattcacgacagtaagaagattagtttaaacggtacaaaacaattcatatattacgaaaacattaaatatcacacgaagagaagaaatatgcaaaacgtctttgctcgaatcttcgacgaagcaacatagtttttcatttgagtgtaacattatttttcgtaaattcccatttcacccttttattacatgacatttgtctttcactgagacagtaaaaactcaagtctaatttggacatttgcatatacatactcatttttttctctatatatatagaccatgtcaatccactaacgatccctaaccgaaaacagagtagtcaagaaacagagtattttttctac

SEQ ID NO: 4218 - DNA, 2000 bp, Arabidopsis thaliana
atttgagatattttgtagattttatagttctatcggactaattcttggcttaatccactaacatgtttttgtttagttaattaaactgattattttctgcgctatagttttgttaaacaccttttagacgtaacaaagcaattacgcttgatcatccatcgtagactctttttctttttttacatctcatagaagttttgtttaaacacagcaggaagtaaattattttcttattacgtacgtatgattgtttttagactattttagtactttgagaagtaaaattggggatacgagataaaagacaattgattaacatgctttttattttgacttccgaaactaatcatggttgtctatgtttataaattgtgttctttttgttgaaaaactcagataatgattaaatcagtagcgaatggatggagaacacatgattttagattgcataccgtaaaacaaaaaaaatcatgatggatgtagaacattcaaatgggtcaaataaatacgtatgtgatcaaaagaaagtatgtgatcaaaagggttagcacgagtaccttgggaggaaattcttctaattatgaattatgcaagaattttcgtcaagggaaggtggggaagaggtagctaaagaatagagaatcatatgactaaggacgtggtggttgaaggaaatgagagaatacatgaagaagagaaacttctttgagtgagaaggaagtgcgctggctggagagaaaagagagaaaagagtttcgagtgagagagagggcgttgagattgtgatcaacttaatgtaatatgttcttttattacattttctttttgtcatatactcaaaccttttactattttgtctcataaatctaacacaccccaccatttgttaatgcatgatggtagaaaatattaaatataattaactacttttatgtgatcaaaattaggtttcagactcgtttcgcgatccgatctacaattacaactgcatgcttctaattgatctaaattctaaattttttatacatattaaaaaaacaactttttgttaaattctcaatcatcatttttgtgattaacaattttttataactctaaaccaataatatttgattatttattttatatgtataatgatgattgagaattttaattagcagtctatttagggttttcctaaagttacaatatgttgttacccttctagttaaattttccaaaataccatatttcataacttttcaaactgtttattaattcaaccgtaaaaagcactaaaatgttacatttgatcattcacccaaattaaattcaaaagtttttccgccaaaactacttggtgacttacgtgcttatatacggacgactattattatgttctatacttttttatactttgttgcacaaatatctactctcccaattcatattctagaaggatgtgctataagaatgggagaaattacacaagaagagcatctttaaatatcctctcacaatctttatgtctaatacacgggtgaacaattaacgacaatttctttattcaggaatataataatgaataacggttaccctacacctagtacactaaatccttaacagccacacattcatacgcaaagagtttataaaactcataaaggtataataataacgagtgaataagtcaaaaaaagtcttctctggacacatggcagatcttaatgagtgaatccttaaactactcattttacaattgcttcgctgtgtatagtttacgtggcattaccagagacacaaactccgtcttcgccttttcttttgcctctaaaatatcttccgccattataaaacagcatgctctcactccaacttttatttatctacaaacattaaatccacctgaactagaacagaaagagagagaaactattatttcagcaaaccataccaacaaaaaagacagagatcttttagttaccttatccagtttcttgaaacagagtactcttctgatc

SEQ ID NO: 4219 - DNA, 928 bp, Arabidopsis thaliana
atagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagca

SEQ ID NO: 4220 - DNA, 995 bp, Arabidopsis thaliana
ttctgttcgtatatttgtaactattatgtgtatttttattttgttagtattactaattcaagtggtttaagttgttgagactctttaaaatctaagcattttataaacaataatatataattattgtttaggctaaatttgtcactaattaaggtttggatacatagtgtctaaactaagctaataatatcacttaacgtttacttgtaacgctaggtgatgatgtcgtcaagtcaattggtacaaggaataaacgagtggtcatatgacattatgaccatatgaattcaaactccagtaatccaatggtaattggattcaatgatcaagacttgaaccacgtaatccacccttatccttagaagctcataaatatcactaaagggacaggcaacacttaaccagtagttgtccaataatttagttttccaaaatgaaaaattattgttgtcatctattttaggtgttttagttcaatgtggattcctcgtcctaacaaatacttgacgaatatatctagactataaaattggttatgagttctacttttttttgtttgtgaaattatcaaaatttgttatatttatttatttattctcattaatttgagtactaatttttaaattatttatactaaaaacaattactaagatacaaaaatggataagagcatggtgtatagatatttaatgggatagaatatttcccataattgtatgtgtgtgagaggttttgttttcgtaaggaaagaaacaaaaaccatttgaccaaagaaaagcaaaagaaggcaaggaatcaaacaacaaatgttgcaaggcagaaataatggacgttatgttaatgtagtgtcgtcacacgtgacttaaaagagacgagtctgcgtgtcaaactaaaaatgtatgcaactataaaaatgggatttgattatctttttagtaccgaagcctaccaaccacatgcacactaattctactcgccaaataaagtgaaaagag

SEQ ID NO: 4221 - DNA, 2000 bp, Arabidopsis thaliana
taaacaaaactggaatattttaacatatcacggtcattaccattttattcatctaaaaactaaaatcactttatatgtccatttgaacttatctgctaattttattgtctattttgcgtcttaataaatagttttcgattttataccaaacgatcaatcgtctactttgcagcatatatacattactactaacaaaaatcacaaaatattaatttgcaaataccttttttgttaatttgtaggtagtgtatacaaaacaaatgcacgtgtgttatatatacataaatgtttgaatgcttttttctcatagatttagaaataatccagatactgaaaatcttagggaacgttggtgtaatgttatttcaaagatactactaccattaattttcaataattttaggtaaattggtaaaaaaaacgaaaaatatatctaatggttaagttataaactagtataatgtatggatcttgaattaattaaatctttagtggacaaaattacattatgaatttggatcatgaagacgtattcatatagtttatctcattcgaattggattccaaacaccatattagattgtaggtaactaggtaagaatcttgcttgcatatcttaatgagacgtggccattctagatttggcaaatataggtttatcccacaaattttatagactagcgaccacattacttcccaagagtgtagttttaacgcattgctaatactttattctatacgcctcttgcgctagtatctatttgatacgctataacgttattgatatggtcgtacggtagataaaacttttaactccgtaatcgtctaaccaatacatcagacattcatcacactcaatgtcatcgatcgatcgtggtaaaaataactggtattcaaagataggtgtgtcttcttattgtctatcttcttatgttttaattatattttcttctgtcatcagcatagttgtttctagattcgttcccttccaaagtatttttgtatgttcaaataaatatttatttatttttatatattttttactccaaattattacttgcgaaaatcatttcatttttctttgtggaaaatctaaagaagataagctattttgttgtttgctgcagttagctatatattgtttgtacaagacaacattggccctttctatttttgttccttcttttgtcccaaacaaaaacactcctctttatgtctccccctttcacaattatgatttcaatcaatcaacactaatttgaccacagtcgctggaaatacaaaaaagtaatttgtggtggcgaaaaaatatatatctactgttgtgtatataactttcttaaaatttgatttgaagatattaagacttttaagacttcttttttagtatgacaataattgaagaaaaatgttggatatacttaattccaatgactgaggaaataaccaaatcaacataaacaaaacaaataattagactacaattttttttgtctctttctttcttttgaatacttattgtccctttatatacgcattaatcactttcttaaatttatagattatattgtaatggatagatacggtttaacttctacatatgaacacaatataccatattactacctcaacttcaatttgaattatacatagtttgacaacccatcatgtgtatgtatcttatcttgcataatcaaataagaaattatatttattttcttacaaaagaaggaaatggcgggacctctataattttctagaggtttggtttgttcgtattgtattaatccaataaacaagtagaataaccaataatattggaccaaaacaagtgctttaacatatgcttttgcctcctcttggtctctactccaccactataaataaaactctctaactcttccaatctcccatcaccaaacaccacacttctcataagaaaaaaaacacaaacatctatcaaatttacaaagttttaaaactaattaaaaaagagcaag

SEQ ID NO: 4222 - DNA, 2000 bp, Arabidopsis thaliana
aatatgttacataaatagtcttatttatgaaaagattaaatttattatcaagagatttaatgtacacaaaccatagttatatacaataaaaaacatttccgaactttattagtatgtgggaaaaaaataaacttatgagttgcgaaatatctaacacaactcaaggataaacattgtaatttctttcatatagcatcatcactagttcaagtgtaaatcgatctaattttgcatagaactgaaaggagtgaacaatgtactaggtaaagaagaacaatgtttttgtttgcatgtgtattaagctctaatttaattcaaagtgtgatatactgatatgattaggctagttcctcatctgggtagacataattataagaattttcgaaacctcatcttaccaaaaacatatataatctctaccatttgtttctctcaatatgccctaccattaatggaccctactttgtacttatgcaataattcttcctgtttttacaatagccattaggtaggtttctttagaaattcggatgacttgtgtatccatcaatttattcgccgttgataacaggttcatgcacaaatttcttaagattgtttcttcttgccttaactttatttttttatcaaaaaaaattagatctagctcacaaatcaaatttgtcacaagatacgaagttatttgtttcaaatttagtcctcgttagtcatttaatgtggttttgttattttgaatcgtttggttagaggaaaataaaatgttatttcaaatcaaatccaaatttggacacattggcaacaaaatgtgttaactttcacttgatgatggtatcaagtcattccaaccattggtttaaaaatgatgacaaatttagtaagcaaatgtgtttcttcttcataaaaaaatacaacaagaagtgaggaagaaacaatgtggtcgactatgattaatgtgatctattgggaacaatgtgattaggcgatgatgaataggtcgtattaaatcgtttactaaaatgatagatcaataacattagcacaaaccaatatatatatatatactaatgcatgatcttctaaaatatttttaaaatccatctaactagttccgaattcgaataacagcaataaacactgattatttatcacaaaggtgtaattttaatcagaaaaatatacaacccttttcaccatatactaaactactgaaaatcaaaggcatgaaagaaaactatcccccaatgtactttagaatataacggtagtccaaatcttcgccacaaaacacaaaaccacatgaactagtcatataataatggataaatgatttaaactatttcactaataatgtgcatcaatccctaaaagtatgccaccagtattcttttatttctcccacaataatatcaataaaaatgattcaaagacaaagagacaacagagacgaaattattcttttgtagatcttattatatataaatgattaactaaaaaccatatacttgtaacaataattattatatcagtactaaaatccaatagtatcaacattgcaaagaaactgttgtgtaaaagataataataatataaagagaaagcaaagaaatcaatctatttcaaaaatctaatcccatctaatgtctctctctccacgcacaaaaggtctaaaagccacaccacacacatcagtcaccagacgtagcagagagcctcactgttgcagagagcactcagtactgttctgtttctctgatacctctctctctcctctctcttttaacattgtccaaattaaaaatctaaactttttttctagttttttttttttctttaatagaaaagttttttttctccacggcttaaagactcactcatcactgtgctactactctctcttcttttggctgagagggtaaaagtcatgaagaaactcctctgagttttttttctttctttcttataataaagctcttatctttatctctgtttctctctcttta

SEQ ID NO: 4223 - DNA, 1130 bp, Arabidopsis thaliana
aaaaacaactaaaagatgatgaaaactaattgtgtaaggtaaatttctatcaaactcttcttttttttggcttaccttacataactaggttcgttgctattgtatatgcagtgtcaacttttcgttttttgtattctactattctttggttggaatgagaatgtgtaaattacttggagacagagttgtttccttttgtatacgttaaacgttttgaaataaccatggcctaataagtctaatctcaactcacaaggatatgaaatcttttttcttagaatgaaattaatcggaaatcaaaatcctaggcgtaatttataaaaaaaaatatgcagtgaaggagctaagttataagttgatatgattgacaattgctttgagacgagctttggtactaaagatcgagccaataatatttgtccgaacagctgaactaagcttggggacaagattgtcatgcggatcaattctgttattttcttaatggattttaggtgattaatcagttgttattgaacagaacaagacagatagagctctaccgacttgcatacttaaatgaaagaaatatgatttattagtaaaataaagagtgatgagatggttttgttgttttaaaacacacatgtttggtaattggcatattccttttagaagatccaaattctcccaacatctttacatggacttccccatttccatcatctccttccacttttttcccaaaataatataaaaaaatgataatttgaatcgatgtaatgagtgtattcaacctcttgtataatttgtctccatgaccaaagacaaagagagaagccataaaaaccctaacaacatccattgttgaaactctctttggcacaacaccaaacacacaaaatatggccatcccctaaagaaactgaagctcaagaaccctctgaatctatcagaagatctcaccaataaagggttttgagaggttcaagtttctctttatgggatggccccaaacacaagagtactcacaaaaggtaagaagaagaagagatctcttggagattatgattgtgaatgttcgtgtgtgggtgttgtgtaaatgatcatcatcatcatcatcatcattatccaatatcataattatcaat

SEQ ID NO: 4224 - DNA, 2000 bp, Arabidopsis thaliana
atagttatattggttgactttggtcatactctaaattactatgaattgcgatgtttggattaggcccttttgaggcttcaacatactaatatccgagcagatgctatgtatctatcttccatttaatttaattttttcgaagggaaaaaagaactagctactactatccaacatcttaatcaatggaaatttctttgtatttgtacttgaataatgaaatttccacaagtcatttacaagtacatgcccgcacacacaaaaaagaaacaatactctacttgcacaaagaaatctccattagtcagatacaaatacaacgaattcttaaggaagccatatattcgtttatgctaatgcacttttcataagataaatgtctactattcgatgaaacataaacccatatttcactagccgaatcatatccaaattgggcaatgataagatgtttcaaagacgaatattctgcttatatcacactattcgtacaactcttttttagtctaatcttttgatgcatttgtacactatggctcatgatgctaagagacacctcaaacttccatgtacgattctttctttcttcttttttttggttaagggcctatacgggccggaccacttggcccattaacctcagaaaaagatgcccagccgcactgtgtaatgtagctctgcctcccaggcagctcattatttctaggcgcttcaaagttcaaatggccagtttcctaatttctcaaatttaggggtcattaaaaacaattggcctttttagttgttatatttttgaatattatttgtttagtaaaagtaataatggcgtaatggacaacaacaacgaaaaataggcaactaaaagaaaattaaaagacagtaatgtcgaaaagcagatcgtccgccgtcgtggaaggagcaaaccggcgaatgacatgaagagacaagtgcgattgacagagctaaattcgtttatttttgagacccacttggactatttttctttccattgccccattccattcatataaaatgaatactaaaacttaaaaaaaaaaaaaaggtcgtgaagccaactccaatccaaaacaaaatttagattctttgggaacttttatatcactagtttaatactaacaagaaattattggagaaaatagactgctggaattaattaagtactctcttgttttcgaattcaatcactggagaaggaagacttgttggtttcaccaaaaagtctcttcttcaatttttttaattcagaggcagtagtagtacactcagatataaaagaaaccaaaacgatcggaatcttcttccacttgttcttttaaaagattaaagcttttttttttctcttaaagcaaaaaaaggaaaactttccctctcgcgtctctctcttttgacctcacattcgctgaatcactcttctgggttttttttttttttttttttctttgccctagatcttaaagacaaggaggatcaaattatacttttttgagatctgggttcggacaaagattctgtctttctgcattctctaccgtttcgattcagctcgaggtaaacttttatttgactctttttgactgagaatgctcgttagtcattacagtgtctttttgttgctggagggttgaatctgggatttgtagcttttgatttttgtttggtcggagaataaatcacgagacttattagacttgttaagcttgtccgtgtgctaaagagtgttttctgaggaatgtcctgcactgcccgtatcacgggaacaacgtgcattttgcttattgcttctgtctgaagcagttttcttcttaagattagtttgaaacattacttaatctctccgtgttttccggaatctctaatctcggagagagtctttgttcttcatcaggcaatgccaatctaaaaggagtaggtgaaaaaagattcaatttttgtatgcctatcaattagaaaggagaagaggggaggtggttagattggtttca

SEQ ID NO: 4225 - DNA, 1729 bp, Arabidopsis thaliana
ctttgactacagtatacagtcagaatcagatatttcagatcccaagcttcgaagtgtgttccaacaaatcaaattcgaaaataacaacacatcagctaagggaatcgacgaagaaaggtattgattgacaaatacctcctctttgttactttgttagagaattgcgcttgttgatgactacagctgcggcggttccgtcggaactgtgaaaagtaattagatttttagagcagaccaaacccatgttttttcggttatctgatattaaccggtttgagagaaaaatacactaaaatacagcaaaaaactatataaattaatgttcgattaattaataaattttataaattaataaaaaatttcggtccgatccatgtaaaaattgacacaaattgataaaataataagataatattttttttgaaaattctatgtaaaatctcattaatatcataaattaataattgtataaacttatcaatatatatatacatatatcatttatatataatatgaatataaaatattattctatatatcatatatgtacacaccaaattattctatagtaatttaggtatgtaaaatattatatttaaaataatttagtgaaatataactctaatattttttattttttaaaaatttgtattaatttttggttgaatttatttttaacgtttttaccatatcgaaaaaggtgtgttattttctaaacttaataattatttttttacttatatttggttttaaaaagctgatattcgattataaagagaaaaactattttgaaatataatttttgtaaaagttatcaaattaataaaatctttctataaattaataattaatttattaataatttaatgtctctatacgttaatagaattttgaaatatattaatttttgtaaagattttactgtaattaattcctatccttttcttttctgacttcaataaacttaaatcacgaacaataagagtcaatctttttgcgtttcgttattttatgatcatcatatgttcgataataaacttaaactcatctgcttggatatataacgaaatgaagtgttacaaagtggttgctttatttttgtcttgaaattttggatatgttgttcgtggattattctagcttcatggtttacttagttttttagttcttggagtcctatcttaatatctttgttttaccgacttgttgctctagaagaaaaaaaatatcttttctcgttggtttttgattgctaaagtttattgaactcgccgactttatgtaatagtaatcgtattattattttttttatttttattttatttttttcttacggacaatcgtattatatttaataaacctagtagatgattatagttattattttcaatatccaaattgaatctaatagcgagtggttaacaattcacaaagtcaaagtcatctcactcctcaaaattcaaaaagtcgtcttggcctttcggttcgtcattccaattgcactatcaatattattaattgccaattgaatttgttttgtttattgagattctttgttagcaaatataaaaatatgaaaatataaatttcagcaagcgatttggtaaagaaagctcgttcgtatataagcttcaattgtgtcgtccgttaacttgtccatttcttcttctttcttgttctacactagaaaacgtaaaagaaactcgttctttcttttctcctcttcgat

SEQ ID NO: 4226 - DNA, 987 bp, Arabidopsis thaliana
acagtaagttcttaattttcattgcttcttatatcagtaacagccatcgtctatatgcgtgggtcaatatttattgtgagcctaataatgttattgtgttgcaacaataatgttttattgattcgtgctatagtgttagtacgtaaatcatttcaatcggccgtgcggaggaggatcttttatttatttatattccacagatctattcttgttccttttactatgaaaattggaagagtagttatagtagatatctgttctggttctggctagctataggttttcctagtaaatgtgggggattttatcattttgtgcatacacagtttcttaagatgatacaattataatttttattttttatatcatatcgcatgaccacaccccaattattgttataattattaccgaatgaaaaacaaaaaccatcctccccaaaatgcgcaacgtctcgtgccttcccttgacgcccgtatagaatgggccatatatatagtcaaataagtattcccactaaactatgcaagtcgtcgtacgtctatccttttttattgaacatatatacacaatttgcaaaatattaaatatcgaaacattttttaatgataatattaaatcatggcagcgccgatgaggttatcactgacatacaaggatacggtttccataatatatgaaaccaagttaaaagaaaatatagaaaatctacatttacttgattttgcaagtctttaagaccatgtgatataaatgaaactaacattgacagctcaaaagtaatggatcgaatgttattagtcgttatatatcttacacgctagcatgatgcatctcatccagccttttatgaatttatcaaccaaacatattttatgtaaaatatcaacaagctagcatgatgcatcactgaaccggcctttaagccacaaccactatatataccaaacatttagaaacgcctccattagacaaaactcaataaaaacc

SEQ ID NO: 4227 - DNA, 1591 bp, Arabidopsis thaliana
atctacagaaaccaaacaaaaagaaaagagcttcacaaaatttcagaatttccagatccgtcgtcgaaatcaaagaagataattaaccgatagagaagaagcaaagaacagtagagaaataagatctcaagcttatggtgaagaacctattcgaaattcgcggcgagaaaatcgatacagagacaaaagagagacgtcgaattaaaaccctagctcagagagggaagtacctgaaaacgagagcgggatgctcgaaaattgtgcgggagagcttttaaagtttggacttattgttgggccggattttgtttagctcttgtggatcttgttgggccggcttttctaaattgttataattcttcattttttgggtcaacatgttaaatttatatttagatatctttacaaaattcgttcaaatcttgtgttgttggaaaataattattttactaaaaatttatatcacataaaattgcaaattattcaaaagaagatttgtagttaaaatatagtggatattcataccacctctcatgatggtatttaaaaaaaataatgaaacgtattctctctttcaaatttttgattatactttttattaaacaaagaaagatttaagtgtggatgatacatcactagtttttttttttttttttttttttttttttttgaaaaacgatacatcagtagtttaattttaaataaacgatctaaattcttgaaaaaaatttcctcaattttatcaatatccttagatttatactaaaaggtatatgtacggagatactacagaatatgccaaaatacgtatacgcagcaaaacgtacgtgcattagatacggaggggtgttttcgtcatcttaaccattcaacttattccgggcgaatttactaactgactccggccgaagtggactcgcagacacgtacccagcagagaagctttgagggtagtgtcgacttttctcaattcaatagtatcgtatcttagccacatgttaagaacgaacaccgttgatctcacgacacgtgcccttgatcattttacagatttagctatttcgaacacgtaggatacacacgtgtacatcaaatctctttccctttataaaacctccccaaaacaaagcttatcctctttagtctttactcttcgccacatcacagattttgttttcttccgtttctcgaaattcagtttcatcatcatcctctctggatttataaattttcaatctacctttcaatcgccgggggataatcgaaacccgatctgtgtaaaaaaaatgatgaaatcgacggcgagatttgcgtctgattgtcgttataatgatcacaaaagcataaaagcgtgacgtttccgcgtcttcgcgtatctcggaaactttaatccgtatctaaagagctaaatttgaagcgatctttctctttttcttttaatattgttttttttccttgaagcttgcctagtttcgaagttattccatgttttatcttcaattctagatcatagtttttggaaatttaggttttagttttttttgttaagctcgatctggatttgccgatttgaaattttgagtaaatcgca

SEQ ID NO: 4228 - DNA, 2000 bp, Arabidopsis thaliana
ataattactttgcttaccattttctattttcatatcaacatcttactcatgtttgtcctccactttcctccactcaactcaagttccctttgagttacgttcgtacatctgttttttttttttcttactttggttaattaacgttacaaacccatatagcagtaaaactttgcggtaaatattaaaattatatacatattattttatattgccatcttttttagacagtaaagttagtaagacgtttaaactcatgaactgaattgatctaatatttatttttatttttatttttttgagcaaaagttggggtaaagttatttggtcttaattcttcattaaaaatcttaccagaatcaagtaatacttctgaactacctgattgctgggaagaaaactacttgacttacgaaatctatttgctgaatgatatgttcaccaaaagattagtcaaggtcctaatacttgtaatcaacttaaaacaacacagtgagttttaaaaccagtgtttataatggagattcgttaactaattagttaaaaaatataaagaagtcaggattccaaacgctactagaatattattcgcaattgatgattttattatcattaatattatcgaattcaaaccagcatataaaacagactccaaaatagtctgaacttttttataaaaaataaaatttttttaataaaaacaagtagtctctagaaaaatacaaaagtatatagtctaatgtctacattcctctgcgtatatatgtgaaaatataatctaatctaaagtcatctcaatcaagatcggtcttgaagactcaatggcaaaataaggcaccggcgaatcttcaaaacatccgaaaactaaaactaatgaagcgatctcaagaactatatcactatatgaatataacagttggacccgccacaaatgacaaatatcatcaaagtttaaattcagtttatatttgagaaagcctatttatactagttaaatgatgttgtgacatgttttagttctcggacctaaaaagtatctgaatttagtactccactaacaaaaagctccaggaatatgatatcattgccttgttggttacttgattcatacaattaaaaacgcaacgaagaatgtcgacatgtcgttattgtttgttgccatttttttgggttaaatggttgatcattcatgttattagtttctcaattgctcaaattttatattctcgtgaaaggcatggaccaaaactttttgcccttacttcttactgataggttaataaagcacattcaaactatgaatataaccgataagatgaaagaaaaatacaacctataaaacatttaaactagcgcgtaattattttcaaatgcattacacgtccttgatcaaaaagtaaaaagttattcaaatttagaatttaatttaggaagaaaaaaaagaagaaaaatagaagatgacaaagtttcgaccgcgtcaatgttcttcccgacgacacgcttcgaaagtcttcttcgttctcattttttccatacgtaaataaatacatttatttcaatttacatatatagtttctaagtaaaatcattttcgcgaaatcaatggtttttttttaaaaaatttatcgttgaaaaatcaattagaactaagaataaaacaaaaggaaaataactttataccaaaaaatgaagaatcatgggccatgacacatcaccataaatgaccaaacccgattaaggggtttgctatattcaaacaaagcgaacctaatcttgttgaaattaatgcctccaatcttcaaattatacaaacacttttaaagatgataaaatcacatatatttctagaaagaagacacactataaataaaaacatccttgctggcaaaaatccatcattcaattttggtcggtcaaatagatcgtcacaaaatgttataaagcattatcacatctttaaattcattcacatttcgatatctttacacattcacatggcgcca

SEQ ID NO: 4229 - DNA, 1049 bp, Arabidopsis thaliana
gcaaatttctgaacaatttgacttcagtgacagtgagttctgcatcaccgaagtctcttataaaatattggtcgctgtaataaggacacagctctcttgttgtgtatgtgtcacagagttcttcattttgcttgtgtaatgaacaattaaacatgctcttttctgagtgtgtgtgcgttttgtgtgtgtcaagtttttcatcgtctcctttattaaactcaaattggcacctaccatcagtaattcatagtttggcatggcccattattcaattggacatttatagttgtaataacgtggatgcccctgtcccattaaaaaatcacaattcatcaccatagctgttaacaaatctcgcattgctgtgctaaaaaaatgagaaatattgatataatagatcattttgatttttggataaacaaatcagtttacaatgttaaggtggaagactttagacttgaactaaaaaacaaagatgttaactgtaacagggtaaggacgttggtgtttactattttgatattttgacgttggttaggtaattgacttagagcttttgatagatgaatgattaacaaaggaattagaagatggacaaccatgttggaagaattttgaaatattacatttttaatacttaggtgttaattgtctgatgaggttttgtattcgggtctttaattaatctaccaatgaagagagttgaccaaaaaaggcaaaaaaaaattgtgggccagtcggcccatgtcttattttctttgaatatgtttagcttatttatctctctgtatacatgttggaatatattttgtgcgttatctaatatagtggttgttgattgtgatggtctgatggacgtagccgtttatttaaaaagaataactaagcgaaaatttcaggtcgtctcgtattacatgccaaagagtttctaaatccgccagagcattgacttgagatgcaagaaacaaattatttcgtttaatcatcattttcctggctcccccgttttgtttccctttgagattgtccgttaaaaaggggacgaacca

SEQ ID NO: 4230 - DNA, 2000 bp, Arabidopsis thaliana
tgaatcaacgactcatatatcacggagcaaaacgcgcatgcagaaaaatccaccaagcgaacaatttggaaagcgatatttctgatgaatcgttgatttccccaatattacgaactttcctgaaatctttcctagccgtcgaatatgaaccaaatttattacctgacctataaacacacacatatgcaggcaaatggacacatgtgttctatgaatcagtgttggtgaagagagagcttgtcgtgtaatgagagttgcatgtgttcaacaactttgtgtatgttttgtaattttcctcttgtgatattttctacggtgagaattccatttgcaaggttacatcaatgggtgaagcctgtacgtccaacatgtgaccagaccttcttttatatcaacggtccaaattaacattacattaacatacacaaatatattatatatttaatactattgttcctgttcttctttttattgtcgttacctcgttagcatcaatgacgaatgaaaatgacaaacgatacattgtgttgttcgaattcgtgttattgttgccaaaacgatgtgataataatggaactatgttcattgtattggcgttgcccgctggtttacaacgatctatttcatcgatgaattttggtaattaacgatataaaattttcaatactaaaagacacacctttttcaacatttctttttataacttatgatgttcccattccattatattatagctcaacttacaaactaacttgtcacatgtaaattactcattgactcgtgacaactattgacggcaatattatcaaactcgtggttggaaatattttaagtccacaaaggaggagaaaataaaattcttgaatattgaaaattcttatacctctatgatataaaagaaaataaaatcaaagagaagtaccacaaaaacaaatttttagtatttaaaaatgccattactttggaaaaggtcccaaaatatcacaaaatctaggcttaggaagggtctctaaacgtttattaagaattactaagcccaaaacttgaaaactcctaaaactctttcttcaaatttagactaatcatttttaattctctccaaaatattagtaacccttgtaaagcctaaacattttagtaaattttatgatttttggtggtaattttggaaaataaagcataaaatgtggtattccgaggactgaccaaatttcaaaaattcaaataaatgattaatatcctaaatcaatcattattttttataattgtttttgagaaacttatattaatactattttcaggcattttcttataaattaccctatggttttagtaggcaacaaaaagatgaacgtctcagatttttttgaattcaatttaatcttaacaaaagcgataaatatcaagaagataattgggtacgtgtattgtgtactatttcaaaattgatatttgcttccataacgtaacgtaacgtaagacccaaagattaacacttggtttcttcatggtcgtagattattaaaagtttataactaatgacgacaaagtttaaacgaaaaacaatattttctcaattttcactagttttttttttttattccagaaaattattagtatacaaccaactatttttacgattataaacttttatttgatgatattcataatttagaaaaaccttaaacggatcttaatgtcaatatcatcagctcatgcaccgcctctcggatatgttgacaaaattaccccatacaatataaaccaccaaaccataaccacaaagggtatattcgtatattataaaaatatctgaatagtcgaacttgtcgttacactcaaaaacgaaatctttccctcctctgttctcaatctttctataaattctcttcttcttcttcttccattttcccaacaacacaaagtctctctctctctgataaaatcttaaaacccacctcgagatcatagtcttcatcaattagccataaaaaagcaca

SEQ ID NO: 4231 - DNA, 549 bp, Arabidopsis thaliana
gtttgaaagaaattaaacaccctcctctgtaatgttcattgcctgacattcagtgtgtaaagtttcaaccttttcttacctcttagatatgaaagccacatggtgctacataactctcacaagttttgttcatagttgtgcaaataaattggatgagggagagattcatttgagtagtataatctctgttctgccaatttgatcaatagattcagtgtatcccaacttataccacttggtgtggttggccaatacataaataagtaaattaatgagataaagagatctaaaagacttttctttagtgttttgactaataattggtcaagcctaccattacaaactatgttccattaccagtacagagcacatggtttcactttttaaccaagcaactttatcttaaacttgcttatcaagaactgtctcttcggtaacacaaaagggtcttttatcaaaacctatatataggatacttttcataattggagtaagatctacaaaacagagagttgtatactttaaatcatttagaggttgtgaaatatt

SEQ ID NO: 4232 - DNA, 1381 bp, Arabidopsis thaliana
aacgctcttgggacatacatggcacgaaagtattaaaggtgaaataagaagtgttgttgtaattgtagtactttttttttttttttttttgataaaaagctagagtaatcttgtgaagtgaaatcacattattaaaagattaataaatcgacttatacaaataaaatgcttgattcttgatatttataccgcacccaaagaacaacagaacataactttgttgcataagtttttgactcctatatgtaaaacttcattcctttcttatctagtattgttggtttcttatctcaattgagcgatcggattagaattggtctgacaactagtttattatgtgaaacttttaaaatgaagagttttgttgtgaatcagagggtttgaaagaatttgatttcagtttaaaagtaaaccgaatttgttcaagtcgttgtaggcctatgttttgtctgtttctatacatgattgatcagtctcttgaaagtatgatatatagatgatagagcttgttttctctatgatatacatgttcctgcaatatatcttgttagattactaactggactaagtctggcacgtaagacaacgatcttccacaagtaattctagtttacaagtcattctaataattttaattaatttcaaaatggttggaataaaattacctagttttactatttaagagaagaccaacatcaaagattattcttatctaatattcaaattatggatattaatgcattcatatacgactcgggattagtatttcttacaagacttgttcaataaaatttcttgccaacaattatgacttttcctgttgtttacaatttttcacaagtctattgtcgattttaaatttgtgttatcacacacaacatgagactagtaaaaccaattgacattgactacaggcttctaccgattaaacttatcttgtataacaaactcaaaccatattttaatttttgttttccaattggcgactactttcagtaaaagtcacttagtttcttgctttttagaaccacaaaaaccaaatatacttttttcacctatctcattttatctctgataatttttctttacactaaatgtttgcatcacaggaacaaaaaaatatttggtttaaccaatttcgtagattgaaacgaaaatgttggtgtttgtttgaaaatttcccaacgtgttacgtgtaacgtttcgaatggtctaagaactaataagcatgcgtggcattggcgttgacgttgactcagaaaactacaagtatattttatttacaacaaaacgtatgcttcacggatccatcatcatctataaaacacgaagctaatgttcatcatctctctctgcagtctgcatcacagacacaaaaaca

SEQ ID NO: 4233 - DNA, 1152 bp, Arabidopsis thaliana
tttttttgtatagacttttagtagtaataattctttttaatagtaatttagaggtattagacttgaatttcgtataaaaattatgagttttaatcttagtggtatatataacaattgttcttcaacaatattaagtgagatttttgtaatatatcattatgatttgctaacccaatatataatggtcaacagatttaaaattatgattttctatattcttgtaaaattgttgtggcaagaaatcatgttcttaccaatttctagcataattatgtcaacagccagctgcaaagttatcttattaactaaaattttatataatacagaagtgtgaacttgtttcaaattagttaaaaagagtgtatattgagtacaattttctaatgatatttaataaaaaaacattgtgttaaaattttaagagattttgtcatgtgattattattattccttatatatatattatcctttatatattaattgagaaacattcttaataaaaacttactcttatatgttattaatgaaaatgtcatgctgacatgttgtgttcgtagagatttgtaatctatttcattcattgtctaacatttactagaatattaacagattttctattagtattatttatacatatctcacacaaataataaaaataaaaaagagatcacatttaaattgataacatatgcaattaaggaatgcactttgttgtttttcaatcaatttacgggtaaaactaactctgatactaaaaatctctgcttcaataaaataataaaatatagtacatgttttttgttacgaaacaagtttcggattctgaatagtgatgatacaataaatttgtagttaactacaatgtatttatttaatcattattttaccccgcacattttgacctctcattttttttgtgttgcctattttcctaacttagctgaattcttgaactcaaagatcttgaatagctctatgctacttgtgctggccaatctgaatttattaataatgtttgatatatattacacgtgtttaattgcatgggacgtgaatatatctttagtaacgggtgggataaactccatgacaataccaaaatttgaactctcgcgcttacgttataaactaagctataacttctaacccccc

SEQ ID NO: 4234 - DNA, 1365 bp, Arabidopsis thaliana
caatccagccttctgcaaaaaagcaaaagaaaagtagcaatttaaaagcatagaaaagagagataatcatagaaggaaaaaaacaagaacacccatcataaaaagaagtatttgtaaacttatctcatcagtgttctcaacgttgagtacacagaagtcgtagagagaaacaaaatgttaacttcaacaatcatgtcattcaaatacttcatctatatagtcattctactctaatgtctatgtctatgcttttatcttagttttccactatactctctaaaaactatatgattcaaaagctcatatctttacttgttagccagcattttaatttggaaaaacaaaacaaaaaaaacagtacagcttatacctttcttcttcctctgggagccatttgttgatccctcacaattccctgtagtttcagaagaaattggaggaccaaaagtataagtctttgggttataatcaaacaaacaaacaaaggcaaccaaacaagtgatcccttttttcaaacctatgtaacaacaaaatcaacgaaagatgaaacaaaacaaaagttgagctctttcccaaaaatcccgaatcagtaacactagagataaaccaaaaataccctaaaattcaaacccaaatgaaacctaaacagaatcacaacaaaacacaaaaacacgaacttaattttgctacagagatgacaatgtgctgagctgtttcgttcagattcgatagggaaagagagtacttacggcggagaagataaaatcggcggcgactgtggaaggtttcttaagaataagccgtggatcgcctcctcgtctcccaaaaatgcttctttgaatgaaatcgaattaaaaaaataatatagtatttgtttgggtcaaccattttctctgttaagtcaaccattttcttattggttactataaaaaataataaagtatgaattacaatgaatggatctcagttgggcttgagatgtgggtcgaaagagcttttagcccaataggaaaaagattcataatgttaaacatgttgggcaatattggcccatcccattgatactactacaaataatataagccgttagatttaggtcatcccacaaaccctgaccgttcatccttccgtcttccgataactatataaacccaagaaacttcttcttcaaccttaagcaaattcttacgcagctttttttctttctctcttccttcctctgttaaaaacagttacagaggttaaagagacagcgccaattcgcgctgtccaccttgtacgagctccaagcttcgtctaggccctccattttctctaccccaaaatttagtttctttagtctcactttatcatttttaagtggaa

SEQ ID NO: 4235 - DNA, 2000 bp, Arabidopsis thaliana
aacatgtaacttggcagagaaaaacatactttagaaaagaccatatataatatacgtttagaactcattaaatagaagtctacctatttattctctaaacaaatattaaaatgatttaaacgtcaccaacgatatttatcgcaaaagtggtaaatttctgtcaattaaaatgtatttttgaaaaaaaagtagaaaaatgttattaaaataaaataaattcattgaagaattttttgaacaagtttagattatggcaatctgttctttacctcattgtcatcaaaaccatatctcttaatttatttttttgtcaggatcataagagcattatacgctaattgaatagcgattgatgagtttcttatcaacacattttgcagttatgcgaatcgttgaaccaaacttgtcgtatctttgctgatattcagaaattattatcttacaaaagaaatgggtgggcatgtccatctctctgtgaacaagaattctccacgttcactaaaatctaaaaatccgaaaagcaattgaaaacgatttgtagagaataataataattaagaacaaaaaaaaaagaattatcaagaagaagaagaatcgagttctttgaatcgcgtcacatgtttatatataaaaaggcttctctgacctgttcagcatggtccaaatattcacttgtcaacttcttaggccatttctagtatttcttgagtgaacgaaaccctaattaacctctttttgtttaaatataaactaaaatatatgaaataagtcttttatgagataatcattgaaatatatataaaaatcgaatttagttgttctgacaaaacttgaaatttatcctttaatcaaaaacaaagagactacttgctacatttgtgagataatcttaatggtataatacaaacgatcatatattctcaaatgttattatctttaactaaaaaatattaaaatcatactattagtgttctgtatatacgtgtcttatgttaacgtatcttttcaatttattttagttagaactttgtagtttgtacacttgttcaatattttctgctgtttttattattactttttcttcttttttgtctcttttgattcttttatattgaagtcttgcctaactctcccaacacgtgtacaattcacacggacgggaaaatgcattccacgcgtgtctgattaatactcttttgttcataaaaacgtcttagtgccatttgttttactcaatagatttatctgtcaaatagttagtgcttcttcttttctttttctgactccaatctatgtagtgatcgagtgcttcaggacaaactaaatatcgaactggcctctaattatttggagcattttgatacacatcgttgttaggcttttgatcaaaattctagaagaaaggacaactggcttaacacgtgtcgataaactttagcttttcctgacggttcatgcacccgaacggcaccaatatagtcgaatatagaaataataaagcttcattgctttctcagtggaaaaaaacttactataattagaatatttctagtaaatatttagacattttacatgtcacgatggaataagaaaaaataaattactgcaatcactcagcggacttttctcataatcgtagtacacaaatttcttactcatgagaaaattttcctcgtgttttttgcacatttatatcgctggaaaatattgtacaacacatcgataaggtcggccagttcatagacgtggcagtatctaaatggttaaacgggtccacaaagaaaatcgtaattagattttagaacagtaagacaaggacgaccgtacttatccttgaagaacctttggcttttccgtagcctatataaaccaactacttactatattgtccaaaagatcgacgaacataaaaacaaaaacatataatttgggtttttagagttcgaaacttgaaatctttttttttttggttgctgaggaatcgaagtagaagagtataa

SEQ ID NO: 4236 - DNA, 682 bp, Arabidopsis thaliana
aactgtctgagagtttctctggccaaaggatgatttatgtatagaatatgttattttcttctacccatcttatatatacggtgaccattctctgtatagtcttagtgacctatcgccatcagcatgagttaagcgtcccagctgacttaggtttagagtttaggcacctaatggctaatgccaatgatgagtcctcccatcatatttgaacattttaccattagttagagccaatgatctggaacctgcctacaagcttccaatgagacaaactataggtgacacaaattgtagatagaaacatgaagaccaaacactacctaataagacaaaccttgcctactcaagaagatcgacattactcattgactcaagaccatgaaagaaaacaaatatcgattacgtgaagactactgaacacaaattgatgacacatctttgaagaaatatcacttaaacacgtacgtagttttttgtttttggttaaatctcatgtaagaaagatattttgtaaaagcacttttgtaaaagacataggcaatttgagagtttttttaatcacaccactcatcaacccaacttcaacaactactccactcagttctaaactctacaaaagagagaaagagagaaagcgagttgtgacataaaatccatggctgaagcttgcagagttaggagg

SEQ ID NO: 4237 - DNA, 472 bp, Arabidopsis thaliana
tttaagaggaagagacaaaagacatttcaatttccctacacatatgtaacatagtttaattttactatttttgatttcgtaagataacaaaacagattcgtgtttgaacgcatataaaattccaacttttactttcgaaaaacaaagctttgtaacttaaagtttggaaatcttaccgattaatgacagaattaatgtttttaatgaaaaataaattgtaacgaaaaatggtgtgccaacgcaccaataccaaaaggctttgacagggcattggtgggtcaaaattgtaacggtcacttactttatcctccttaataaagctacacaattaataaattaaagaggcaaaaaataatgctaaacaaaccctaaattcccaatttccgaagtgatcactttttccccgctctcttcgtagtgatcgtccccaccacaccagaccccgctcctcaatttcgatgtcgacctatta

SEQ ID NO: 4238 - DNA, 2000 bp, Arabidopsis thaliana
tattttaaaaatacagattttaaaattaatttatttctataattttatgttaagtagtttatatttaattatgttaattaagacttaagagatgtaattttatgcttaattgtgtacgtaagtttataataatagtattttattaaattattaagatttatgattttgtatttcatagatgatcactatagtaccagaaaataaaattatgaggtataaaataaaactgtattttattaagtgaattttcgatcactatatattttttaattagtaaaagctttgatattgaaggcaaatatcaaaatcaccatattttatggtttctgaactatattttcattattcagctgctgctttcagatgtcgcaacttgcacaatatgaaagtaataaaaaatttcaagattcacccgtagaaaactctaaatacgcattaatacacatattgacaatgtgtatataaaattataaacacgtatagttatagaaaaagaagcacatctgcttgaacttttggaggacaaaagactttgacaaaatgaatgcaagacaaaatcaatcatcatcgctgtcgtgatcattgccttatcatatacactttcaatattcaaggcaacgatcttcgtttattcaggacagctgccttattttatttttaatacttttttgtgaacttcctttttaggcgaattttaaatagtaatggccaatggccatacgtatcttacttttttcttgttgttaatttacaaatagagcaacaatctgtttagacaaatctttcacgtatctttagttatcatttttcattcatgcataaaagtgttcctcaattattgcaagctcacttatctttatttaagtggattaaacgacctataatctgatatatgtaaccgaatcatcaacattataattttgtttattaattacgtgaaaccgacttaccgagagactccgaggttggaattggtccatttcaagtttttattttattttctactcatttttatcattagttcattagtttgtaatattatttaatctggtgtcctgtatatattattcgtaatttttcttacatttgaaaacaaaacatcaaaaatctagtctgatctcaattaaactgcctttcataaaaaaaaatatcggcttaattaattaggtcagataaaaaaattgttttgatttttagtaatttgtggtgttttgttattctagaccataaaccaatatcaactaagtcacatttacctttggtggtgaagatacgaaatacacgaaaatatgtcaaattgtggatacttaatgtaactcttctttttttttgcggtaaatgtattaggcgttttatgaaatggcatataattaacgatatatctcataataaaggaaggaaataattttaattaaaatgtcaactctggtctatcgtatacacgtagataggttacgactgttccttttttattttgtctaatatcggcaacatgaatttacgcacacacactcacacacagacgatattttagcgtagtttcacattaacagccaccataagaccaataaaagatgagaatgccagaagatgagtcttacggatatatatgaacatattgactctttatgaattttcaaatatctctggcgtgtccaaaacacccaccaaattagtcccacgacctaatattataatagtaataaacattattatagcaataaaaaaaactcaattacttcttgctaacacacacaaagccacaatataaaaccccctctcaacgtaccaaaaatttcaccacctccccataacgaaaaattcatttcacttttcctataacaattcaagattaagctatgggttatgaaaccaaatcgactttggacaccgagagatcgaccgcgccaggaaccggcaccacgacgaagagttgttcgatgactcaagttgtcctaagatttgttctgtttgcagccactttgacatcaatagtggta

SEQ ID NO: 4239 - DNA, 2000 bp, Arabidopsis thaliana
ctgatcatctcaaaatatgtgacacatagtatactatacaatatgagctggttttgttttttattttatatcgaaagatattttactttatctgacagctgcgagagatcctaaaaaaaatgaattaactttaaagaaattgcatgcgtctatctatctacgtatatctcaaaaataaaaataaaatcaaggtcacatgactcatatccagtgaataaaaaatattcatgaaatcgtaaataaataaataaaaacagaaattcatatatacgtttttagttatataactatacgattggttcagtgtatttgttgcccaaccaaagctactttcacttcacatatcattacatggtccaatgattatggaacacgtattattatttttgtttaaaaacaagtaaataaataaaacagacaccaaataaaaaaggaaacacaaagatatttacggaagttaaaagagaggtgttgtctatgtcagtgcaatgaacctcttcggctcatcttttcccgccatcccaactaacagatctctcaccgtacacgccatcctcttcaccaaatctaatgactttctctctgtctacgtggcgatcatccggtctgttttccgacaataatgggacccatttgattgttatttcgaaaatgattttatttttcttcaatattgtttttttcttcaatattgttttggaagtaaaaagaatcatctgttgacaacacaacacttcttgccttctcgagtttgattctcctcctttctgtttttggtatccacccgattgtcattattttattttgaactctagaaccaaaaatatcagagcaagctctctagtcagtaaattttgtaattattatagtacctcatttttattagtagcattaatgtactagtgtggtcagtgtagatgaatatattttctactaaactaataaaaattgtatcataatttgtatattttttggtgttttcatcttttactataaaatatatttttgtgacatatggcatgttacactaaacaaaaaataaaataaaagaaatttgtttttgtataaaataagtaaattacgttttttgtcgaccaattttgattaaagctcaaaagaaaagagcaattcctaagagatattatttttatgtgaaataagtaaattactcattatgtaaaaagtttggatttatcttaaatctaatttcataacgtttaatgcaagatattttggtaaaataggaaacgtataaaacatctgtattcaaaacttctataaagatacccaataataatggaggggtgacacgatagtaaatagaataagaaataaaatttaatcaagtcaaaataaaataaataccctttgtttttgtttccacaattccttaagtctttctaattactttgttgttcactaaaacatctcacattgtgctattttttttaataaataaagacctctctctttaaaactgattatcccctaaactatttgtttgtgagaaagaaagagaaaaaaaagtttttttggttggaaattaattgagggagagagagagttcagaatctctaaatggctgaaacgaattgcccagaatccaggaaactctgattttagtccttttttcctcgggaaaacgtttgctttttcttttttgtgtgtgtttggttctttaattgacaaatctctctctatctgtttcatgtgctagctaaggttgtcttcactttcctctaatgagtcatgagtttcttgtcttcatcttcatctaataaagttaacaacactctcatcaatttttattatgttcaaatctgtctgacttttcgttcttttctcttacacccaagcgttttaacaatctaacatctgtctctttgaatacttagatatccaacttcaatttctctcctttctcttcccaactttgattcctgatttgggtttttgttaaagttcaagaaagttcttttttctttttttttcctccttta

SEQ ID NO: 4240 - DNA, 2000 bp, Arabidopsis thaliana
aaagaaaaacataccggaaatgagatcctctctttctaagtaattattggcgttataactttcatcataaatcataagcacggcttataggtatacatgtcactgaaacttgtatcaaaacatgtaactaacaaatatcattagttattgtatatatataaacaaaaatgctatgacaggaagcaatctaaagactatactcattaacgaattaggttctacaattacactcgatcacataaatttctgttttatatttattacaaacccatgtatgtgtagagtctatagtttaatagtgtttaattaaaatttatcacaaacccatgtatgtgtagagtttaatagagaaggaaaattttagtgaatcgctaaggtaatgacaagatacaatgatacatgcattctaagtaactccatgcgaaacgatcctaatattgacttacaaacatatagcattttggctgtagtatatttaataatgttgtaggacacaacatgtagattaattgattaaagacaacgtgcatgtctcttttttttctctatgatgcgggccttttagcagaggaatgctacagacatgtaaagttttgataaaattgaataattagctaattatggcctgacttgtttaacctctatatccagaatgaacattatattgaaaactgatctttccacaactatatatgtaatatagttttttttgttttgttgcattctgatctcgtcattctgatgtaatatagatccttgccatcataaaaaaaaatggtaatcgatttttagttaagtatgaagttgtcctcttagtttaaaattacagtcagcgcaaatgaattatcttcccagaaatcaattaattttcttgcattttaaaaagccagacataaagttttgactgattaagacatacatgtatatatatggttaaatgatttatcatttttctcgatcgattggataaaggacatggttttcttagaaaagaatataagataaatgacaaataacagaaagaagcgtgattgcctttacttgcatgcagatgcagtagtctcccattttgaatgactgctctaaactcttaaagtataactattctcgtcaactaaagtttttgtttcttttttaaacgtcaactaaagtctatatcaataacaataatttatcgcctaaccagtaaccatagataaagaaaactttaaatctagaaaccattagcttctgaaacaaagtaaaacagcccttaataaagccatgaccatgtcaactgtttcggaccatgtgtagtgtacgtagtaaacatttaaattgataatgaaatagcaagacgcaaatggacgtttgtaaaaattgtatggttggtaaaaaagacatgaggctatatatgaatttctgtcattaaatcagctttaggtattacttgttaggattaaggttatcgtagttgattagactaattaactaatatatgaaccaaaaaagtataatagtcaggagtagtagttgagatttcaaaaagattcaaggtggccataacacaaatattattcgcaatgacaagtgaagcatcgttttcacttttcaacttatccctctcaatccccaccaccaccactctctattccctcatatagatagatcatcctagtgatcatatacacacacaaacattgatagagaacaaaacgaaattggaaaaattcattttaaattttaaaaatacaaaaataatggaattggaaaaagtcttttttttgtaaatactaatcaaatattttaaaattaacaaaaaattcaatagtaaaaaaaagccatcaaaaaatgatgtcaacaattagataagtatttagtctttttctcttttaaaaaatgatatgcaagctggccggcgctacttgtgcgcacacataaaagcatatatataagatccctcactcgattcatgtaattatacacatatagagagattgagtgaaaatatttttttttaa

SEQ ID NO: 4241 - DNA, 2000 bp, Arabidopsis thaliana
gccaacagtagattttagtgagttagtaacatagaaagattagctgaatgtaattaaaagtatcgagtgttctgatgtcataatcaacaactgtaattttttttataacataattgagattatatggaatcttattttggattcatttattttagtcgcgatcgagtactagaatattggtaatcttgaatactctaaatttttggatgatcaatcacctcaagacataacgtactttgatttttcactgaagaacaactcgtttttgccgacatcttcccatccaaaaaaaaaaaaaaaactcgtttcgagagtgatattttttttaattccaaaactacaatacgtactcgacctaatccgcagtagtacaactaaaagaaccgcaaaagaacaactgctaatgagcaagagagtattccaagattattaaccttgttttatattcttaagatcttcttttttttttaagttctttaatgtataatagaagtatataggattaactgcgacttggtagatagactaatttcagatgctaagatataccatatggtaatgatcctagtaaaattacttttgttaaacatatatgtacgaacagtaggacacgtatagtcatgttttctgatagacgattagtgttgccgttatatcattatccgaattaatcttgtaatgcatgtttttaagtgaaataaaatttcaaattacaacgtagtttaataatataagtcataaccgatacaatagtcactagaacataaaactaatatatatgtccaactttacaacgtatactctttttttggaatttttgttttgtcctaaattggtgtttcttatatcttgatgcctaatctttgttttgtaacatgcgcaatgatattaaaacattatattatactaggggaggagaacaaattaaaatttcacacaactactctatagaactgaattattcataaacggacgagagcatttcaactgctcgaaatattttcctatcatcaggagtggcgtttcgtcagattaccacgccaatttatttctttaagtctgtcaaacgttggcatcttctaataaactgatatatatatatgtggattctaaacaaacaaaaaaaaaacttgagaggatatttttagattttcatcctggaaaaataagtgaggctagagaagattttgatgaaagaaatctttaaattttaaactcttttggaaatatcttgaaaaaggattttccctgtaatttataagcggaaacaattcggaccggggccaaaacatgttagaaatatgtggatttgcagatttctgttcgggtcggccggttctgcctagttgtctagttgactaaggttttgtggacgggttcgttatttttctagcgactaagtaaacatgccctcttccatgacctggcgtctagaagaatagtcacggaacgtgtgttccacactcgttatagaccgtattcaactattcaatttttcccaaagaaattacttaagaatttaattagcaagttgggtcttagtaactgaaaacagatacatatttctaatgttattttatgagttgtcgtttgaacaatgtccactaaatgataacgtgcaagacattcgtgaatgtctaatgtgaaaaattccgttttataaggcgaaatgaccattattttatcttataaacaatagtcaattgtgtttcataggaaatttaatatattcaattgaaacaccagcagagatcaagaagatagtggaaggccatgcaatgtcctcctcgagctcctcttgtatttcaaccctcattaagaaacagaggaaaaatgcaaatgggattatctaaatcttgtttggcatttctccatggactatttcaaagccgctgggtgatctataaaaggcctgagaatgtctccttcatcttcatctccaaagctcgttctcaccttacttggcaaacactcaacgaagaaaggagagagagacggta

SEQ ID NO: 4242 - DNA, 2000 bp, Arabidopsis thaliana
taaagctcaagtctttccatggacagagataagcaagaaaaagtattaacattgttcacctcaaaataatttaggaaaatgacaatgagatttttacctcaaaagccaaaatcaacatctacccattctttcactcgtcacaatcatgagtttcttacaatgcttaccttagagtttagagacatattctcacaaaaaaagcttgtgtctatttcaaattcttgaccgtagatgtcacaacatgcatatatcattgaaaacagagcaacacaggaaaccaagcatatgtatctagatatacttagcaagacataactatagtctttgaatcaacatagggattaatgatagagaatgaggaagctcaagattttatactcagtttcttacaaaacaaatttctctctaactgcaaaaacaccaattaggatttgaagagcgtacctgtttgagtcaatgtccaatgtcgtccccccgccttctacatttcttagcctgctgaataaaagcacaagccaaaatgagaaggtgccaaaggcgataaggatcaatttctaccattcaaaaaactaatggtgagaattagaaacgagagaaaactacttgttgaggaaatagccaaaagcgcaatcttcgtcacctgaataaagaccaaaccgtcactttcaatgagtcagcaagaaaaagagagagagagagagagagattctctataacatttgagtcgacatggattctaatgcatcaaaagtcatctccaataaacaaacacttgaaactcacatggctaatagaacaagatcaaagccttaagtattaagcattacagacactactggctaacttttgacacatgttcttaagtaacatagtatcaatatccgtgaatcacatcgaacacacacaacaagggcttaatgcatcaaagtcctgttatttccatataacaacatatttcatttacaaacagaatgcagcattcaggcagtccaaatggaaaggttgacaaaaaaatataatcttgtaactctacatatatggcagaatgtaataaccaggcaagaaaaaaacagaataaacagatcaatgagtatgatataaaaaaaagtcacaaagaatgtgccacagtgaacaagagggccatgagaagaaattttcaaagaaaatattagcattgttagaattttttgggtcaatggatctgtcagctgcttagttggaaaacacaaatcttacaggaaggaaagtccaagaaaaagaaaataagcaaagttaatagccaccacaagaaatttcatacagaaataattaaatcgttgcacttatcttcttattcaaactaaaatcaagagaacttaataattttcagccacacgaaccatgtgttcaaagccaaaggtgagaagccaaaattatcagcttatctccattaacaagggaaaagcaagactagatttaagagttctctgtaactaaaaactgcaggagtgagtaagtaaataattcaccaacaggaaaacaaaactcaattatctatagctgaatacacatgtaaatgagaatttattaactaaaacatcttcctttgtaactgatgtgacatttacaatttttcattttgaggtgtaagaaccgtgtgacaagtgaaaaggttaaaataagcaacctttgtgatattttctctccactttttgaaattgggtctccaaaccacagccaatcaatattctttataaatacaaacacacaaacagcatctttctctcaaacacaaacatatcttctatcaaacaccaacagctctattctctacctcatttctcatcataacaaagagagagaaaaaaactatggaattgacactgaattcctcgagttctcttatcaaacgtaaagatgccaagagttctagaaaccaagaaagttcctccaacaacatgacctttgcgaagatgaagccgccaacatatcaattccaagcaaagaactcggttaaggaa

SEQ ID NO: 4243 - DNA, 768 bp, Arabidopsis thaliana
ataaatctgaaatatcatcatcactgcatatcaattacaaattcagtgtccaccacaataataagccatatgagaatacataatgtatgagaactaagcaaatgataatattcacaagaatggttttatgaataatgattcgtgagctagataactatattattacctgaaaattatgttttatggtttctccattgatttaaacttataggatacagatttatacaccatatttcatgataatctctatcaaaataatgaatttataagcaatcgagtaaatacaaatataggcgccgaatggagatgtacggtacaactgcgaatttttttaagtcataagtaatttttaaaaaatgttatctctatttttagttacgagtaattgttttaatattatatcaaaaattaatattattgtccaactagtgtgatttgacctggtacatgacacggaacaaacatctaacacaacttgtcaagttgtatatcactgtaacatcagctttaattagaaagatacttttattttgcattttaataagtgtaaagtttcttatccgcagagccaaaatgtcgcttttaaaaagaaaaattccaaagttatttctttatgcaagaaaaaattcgaaattttaattatcacgtaaaatcataaaagaatctcaaaggaaagcgacaattttggaaaattcaacgataagctttataatttttctacttatgagtggatgtgtgaagagtagggaaaaagtacgaaaggaaaat

SEQ ID NO: 4244 - DNA, 2000 bp, Arabidopsis thaliana
caaaatgtttactctaatgtttcaatttaatgaatcattcggtattttgaagcatgttagagcctggtagtactgtgcatgttatacagccaatatcaacctttttcgctagttttatgtaaggctatatcgtttatttatgtagcaaccatttaaattgttagtcctttttaaaattattgcaagatgtgagtgtgtacattcatacattgatgacggactggtttctagttagttggtattaagccgaccaacattaattgttggtttatgtctacacatgggtactagtctaccatttattatcatcattatttcatttatcttgcaaattaatactttgatctgtttattgattaattctctctattgttcattatgctgtacataaacctaaatatatgaattattagcatctgatgaactggatctttccaatattgaagtttgagagttggtatgcgtactgttgaaacatgtgtttcatgcagtaatcacgatattatggaaacgacgtcgctgccttttgtctttgttttctttttctctattatttcccagtaatcacgatattagaaatgatttaactattaaaagcattacattttaccaacaactttatcccaatgaaaacaaaacagggacaataagtccactttgggacctcaaatccgaacattttatttacctacaaagctacaagctacaactacccgtccgaggtctattttggacaccttggcacaatcaatatgaaataactagaaaaatactcgaaaactaactagatatgcaactccaaaactaattacttctttatcagatttataatatgaaataaattcattatgtaaagggtcccttatataacaaacgtcttaacgaagacagcaaatttataaatgacaatgactacaatactggaacagctaatagggatggtatataatggagaaacaaatcgaaatgtgctgctattaagaagtcatagtaattcattatcatcaatttaccatggcccatattaaggagtttgtatgcatgtgggatacacatttatacaaagaaataacaaatttgaatatttgggacacgctttcgtctacccttgttcttgcaatttggacagtgaacgcttctcatgaatgagaggtacgtttctcgaacacgttctccctttaaatttactatttacaacatattatatcaacttacccgtcgctgacccagtgcatttgcactacgtgcagccaacctgcttataatattcaattgatatataattttataacttgccctcactcaattttggataacctacatacacttgctaataaaaacatcatggatgtctaaaacgtttaagtttaattataaggaaatatataacaaacatgtcatattttgttgtgttgtagtggtataattaacaagttatgttgtttatcaaaaacttcaaaaaaaaaaaaaattaggttacaccaaaatagaatgttatgatgcccaaatatatgtgtgaaaaaaaagataaaccaaatttatgatctaccatatgacttatgagattcagctaggttttgttagacttttgtaacttgcatttcgtgtgaacaaaacatgaaaaataatctgactacttaatttaatatcaaggtcccatataagtagttgagctaatagtattatctcggaaccacccatcattaaattcgaatattattccatcttttttttttttttgttaagtcattactattattaatctttaaaatatttttatctttcttgcactctatatatctctccatccctacttgccctcatttcaccaaaatcctcctaattcaccaattttagaattcccattctcattttctctctctttctatttctccaaatttgcctaaagattttacattttatcttcaatccttccttgatttacgtttgaaatatttcgacccaaaactatactgatggagagaacaaacagcattgag

SEQ ID NO: 4245 - DNA, 2000 bp, Arabidopsis thaliana
aatgttgtgttttttttttagtttaataataatactagtattttcagatttttatatgattgttaataaaattatttcgagtcatccataatggtcctgaacaacttcatagccgtgtgtataaatatgtgtttgtatacaaaagagaaaataacaaatgaaatgaaacgacgtttttgttttctattgggtaagaattaaatttctagtaaatctgttataaaatttacatacatagagtgtaataaacaaaaataagggagcagtttggacaaagagtttgcagtgagtctgataaaacgacacaacctgattcaagtctaaccatgcaactaaattgaagacctagaaaaattaatgttaattgagtttcaactaaccatttcaaatttgtgttaagctaatttatttatcttaatcaactaacgtaatttgtttttaaactgctatttgctaaattcattatgtaggagtagccgagtaggaccctgaatggtacgctcaaaagaggtagcagcgtcatcgaacttaacgttaggacaccctatgattgatcgtatcaaatgaccaaaattaaaaagatgattgagtaaaccaattaattttggtatataaacaatctttttattatcgtacacatttttgggatgtgatgtgactaatgaaaggtttaaatatatttaaacatgataaacgcagaaaccaccatatagaggagaaactagaaaaatataatttgtcagtcatgtgtctaaatccacacctacttttttctcatgctttttttcttcctgcaaatattgcatttcctttgcctctctcacacatttcctctgtcactttcttttttatatatttttatttcggaattccattaccgtgaaaaagctttgtttacaacagtaattttgtttcaaatgctttcttgttgtctatttttatcaattactatgcctctgcttgaataacttaaaaacacaagtgatgttaattgtgttattgtagatcctatgaacaaatttaatttatagacgtgtgaagttataaatgaaagatatcattgagtgagtgatcaccgttgcagataatgtttaaagaaaaaaaaaaggaacagttccttgttcatgtcatcatgtgttgaaaacggaaggagggaaagaaaaatctatcactctcagattcagagcctcacgtggggtaaacttagaattctatttttaggtacgaatcaaaatatacgacccgtcgcttttaacatgtcatttattatacctttcactctcatttcctccatgctttttttttaaaacgtaattagacctattcattctccataatataatacataaatacaacttataagattaatagcctcgtacactaacattaaagagtaaataaccgtttgtattttccatcttttgattaatgataactataatttatgaagaacatccataaactcatgagttttattttgaacgcaacatccatatttagctttacattcatttttttaataagatttcagtcatagttcgaaaaatgaatgttgggttggttccgatggtaaagcgagccgtatcaacaaaaaaggcccaaataaaaagtggtatactgttgggcctaaagatgaatatacagaagcccatattaagacaattcggcccattcagcattgcgtagcaatcgaattgatatttagcaaatcgaggaaagcaattgactaactagataatactgataagtgggtcccacataattctgacagcttagagatggagaagatcatcaccgttagtccaagttgggtcaataaggcttacgccgttggatatcaagatatccgttagatcgcatacacgtggatactgttcaatactcctgaccgcaggggataagacacgtgttatattaacgaagagtaagaatggtttctaataatttcttcgctccctttcttcttcttctctccttctttgaattttgattttggttga

SEQ ID NO: 4246 - DNA, 2000 bp, Arabidopsis thaliana
tatcataaacgtagttattgttgatcttcaatgtacactacatcaaacttaaccctaaaagtaaaaactatactgcaaatcctaaacattaaatttgaagctacaaatcctaaaccctaactccaaaagctaaaacttgaaacacacaaagtttctttacgtacatctattagatatcgataggacttgacagtgacaagttcatgtatacatgcactatcatatagttataacttctaaggtactatatcgcaatttgcttgtagtttgacaaaacatgcaaacacatctcttctttttgacaaacgtcgtgaaaaaatgtttttttttgttctttatgatgaggaggattcaacgaattcttacaaaaaaacgaaaatgagcgattaggattaatcagtcgtcatcgggttgactttatttggaaccactaatatttttgcttatatttggacctcacagagtcacagcgtcaattcctacgtaaactcgaaacatatttagaaattataatcgtcaacatctaacataagacgattcttatggatgaataatgttgagtagaaatataaaatatctagtcttagccgacaacaaacacgtctttgagctcagccaaaaataaaaatatgaatttaaattattgtattaatgttacttactgagaccaatatacatacacgaagggttcaaaccgtacaatagatatataggattttgatagttacatattaaacgtttacataatgaattgcttaatacacattattgattattgtgtggcctcaatacacgcaatcgcctcattgagcagcataccaaaaccgtctcggccttttttcccagtagatcatatatgaagttatatacatatgcatatgaccatgaagttatttaaggcatgcaagacatatatagttgtttcggtgtatacaagactcataaatggatgtatctaggtgaaaaccacttggtggggattcaatcaagaatcaaagatgaaatgttcttttgggacgaatagtttttattgattttgagaaacagtaaaccagctcaacgacagaagcaaatggatgtatgtggggacactaccaagaatcaaaatgttaaaatgttaaaatttcgtagttctttatatataattaaacatatttgttctcaaaccatggtttgatttaaataattaaatcatgaaactaacctaactatttagtaaaccatgttaaaaaaaaataacaaaaaaaaacaatcaaaattgatgagttgcggtttccatgatattgtcctagttaattgctcgaccgctctgttttaaccttttgcatagagaacaaatttgtgggttcttgatacacacccctaaaaaccgaatcatgtaggaggattttaatgtcttcataatttatgcattaaagaatcttaattaaattcataaacattacatatatattaatcatatattatatacatatcacaaattttcgagtaagtttctaaatactttgggtgtgtctccatggccgggctcagcttgattataactacactaggaatttattatattactcgacctgacgtatagaagccgtcaagtaaaagagctacgaaccaagataaatctgaatatcttgtgcatccacgaactcatgatggtgttgataataacagcattgacaacttgacattaatacttatatgaatgcacgtatatataaagtattttcttaattttaaaatggtttacaaaaaacaaaatccaaataatttcaaggttctacgtacctagctacatgcatataggaaaaatggtcagaatttatatatatatatatatatatatacaaataattacaaatatctataaataaattttaaactaaatcaagttggtcctcttcccatccttctaaaatcctataaataccaacatcttctcttcatatctatttattcaataacccttacaacaccgaatataactttgaaaaaaaaaacaa

SEQ ID NO: 4247 - DNA, 1445 bp, Arabidopsis thaliana
tactctgtattatgattctgcagatgaatgtgatgcagtttgttgctttttgtatttctaggagataaaagaggtccccaagaacatacaaaatccagatgtagatcgtctataatcaagacgagatgcccaatctgcatctgtttaaacttggagtaactagcaaagcttgattctctctgtaacaaatttcttctaacttggctctgataccatgttagaagaaagtttgttagagagagaatcaagaaattctgttattctcattaatgaatgttgttctgattacattcgtttcatagaatgagaaccaagatcctgtttattaatacgagattacaattaccaaatcatttatggtttatcataaaccaaactctaatagatcaaaccatatatgatcccactttcaaaaaaatctcttgaaaattttaagactgtgataaaaaaaaaaaagtattatattcaataagagaatcatttttttttgtgtgtgccagcaattagagaatcataaaaagtaatcatattccccacaaaactctaaaccgtaatataataaaaatcaccacgttcgtttgtgtgtaacttaaggcaagtttttgaaaatatcatacttttttttgcattcacgtattctataacagatctaattttcacattaaaccaaaaacatatacatttctatagagttgtaataataacaaaaatatgaaataataacataaaaaataaaaggcattaaagaagaggaagaggacacatgaatttcagcgttatttttcaaacttcacttcatacccgcgcactaacccatccatacgttggccgattgaaaataaaaaacctagagatagagagagagagttcaaaaaaggtatcatgtggaggagagagatagagagagtaatgactaatgagaacaaattttcttatagttgcaaatggtaacgagaagtttctttaaacgaaaccaaatgttcatgaatcgtttaatcaacacaaactcaaaaacaaaatccctaatttctctatttgggtaaaaaatctcaactttttgttttctttctatctataagaaatctctttcccttttaccgttttctcagtcgcaattcaatctctcttataaaactcagaagaatttgccgattagtgatgcaaaaaacgagatcctttaagggtttttgatttctttttagttttctggaaaaagtttggatttttattttaattttctcggataagagaaaaaaagtgtgaggaggggtctctcttctttgtgggatcgatagagatagtttttgggttttttataataaaggagaaggagcgtcgaagctaaaattaacgattagactaaagaattttttacagacgagagagcgtcagagagagagaaaggccaaaactttttaatggaagagacaactaagcagaacaac

SEQ ID NO: 4248 - DNA, 2000 bp, Arabidopsis thaliana
ataatcaatacttattgactaaaattttcccaaaagaaagaagaatcaaatgattactctatgtagtaacccaaactgatcctaacaaaattgtagaaatgcagatggtttaaatatgtggcgctctcataaaactcctacttcaggtaatctttttacacagtttggagctatcgtagctcttaacattttcactccagcaatgactagaaccaacagaacaatgagagattggcttctatccatagaaagcttcaacacgaaaaccgaccaaaacgaaatgttaaacccaagccttcttcaagcatagctgtatcatattctatcttccttgtaagagttccttttgttaaaaactaaatactaaatccgacttaaagaataataatcaagaacttcaaaatagcaaagtaaaatatacacacgcacaaattgataagagttcacttagcttgcagtacgagaactaggcaggggcagacctagcttaagagtgtaggtgtggcaggtgtttaattatatagaatttactttgtggcactaacatatttttgttttataatgcaaaataagatgttaaatttgattaaatttatatacaatacaagtttgtgttctatgtaaaatatttttctagatcaaacaaggtctagttttaaacgatccatgggagtataaattttatctttttcactctaccttgaaaaatgcgcatgagataaaatcataggtacatatacatacgtgaagaatagcatcagaaaatattgttctaactattccgataactaacaaaaccttaggaaacctcatcaagactagttcgaattaaatcataaggtttaggttgagagagtcaaagagggaatgatataaatagaagaatattttttgtttaagaatgatttttagacaatggaaagaagaatatgttaaggtggtatagacgacgagcaataatacaacagccacaaaagtggcaaacaaaaaggacctacgctggaaaaaaaacacgtgatgttacaatcaccctttcattctcaatgatgaacaataatgtttattattgataagaaaaacaataatgtaaatttatactttctcgttaaccagatttgttttttcattatgcgtttgcagtataaaaatagtaaaatacgttttaagtattaaactgtttgatagtttttttttatatatatacctaacagaaaccaactatttaaacaatacaaaaatatctgcaaagatatatatataatacaatcgaattcttaaaagttatatatatttgcaaacgtccctttagttattcccctccaactctccatgttggatcaatcattcaatttttttttaataaccaaaagttaaatgtacaaatatgcaagaacctacaggtacgtttacgtgatatataaattaaaatattgcatctcgtaccgaagcgcattaccgtatttaaaatacctgaaagtaggaaaatatagtactatacaaacaccacttttcggacattattttcatagaaaagttacgaattatcctttttaactattgatctatttaaataatttactaaccataactatcttgttacgttttcacaaaaaaaaaaaaaaaaaaatctcattacgtacgtgtatatatatggaatagctcataacctcaccactaccacagaaatcatgcctcttggttcttttccataagcttataacatatattttttttaaaatctactctgcgttaaaaaaatgaaaacacgtagcagcagtgtgggtaagatcaaagggtgtttctcgatcagtttcatattcagatgtatcagagttctcattaacagatctgtttctttttccttatctgattaaacaatttccttcagaattttacttttttgaacatatatagtttttctctgttcctatatcttgagttttgtgagaggttaattatatgaaattttacgcattattgttcatctatatcgaaaaaca

SEQ ID NO: 4249 - DNA, 673 bp, Arabidopsis thaliana
aaccaatagaggtcagagcaaagtaaaggaccaatgattttgcattctcaaacttatttagacacaaaactttgatcccaacggtaccatttttctttgtattttttgtcttatttataaaagaaacatttaaaaaggttttatttcatagctcttcaaatccttgttcatcaccatttcttccactaagaaaaattgaaaactttttgtctccgggctttggtatgggccacttaggactgcactaagtattgagcctataaggcctttgtgtaactctgttaatattatccagctttaaaattgaacactcgacaaagggtaattcagtaattataaggtttttcaaaacacttgtcgttttgtttacaatttacattttaagcaatgggagcaaactacataccgtttcttatctgttgcacgaaacggcatcgtttactaccaattatctttgcttcatttcctatccctttaaaacccttatcgtgttttttgtttcatgtaaaacccctctcgacattttgcgactcttcttctccttatcctctaaatctctcaccggtcaccgacgacgggaacttggtagttacaggaacaagaaatgtcctcgaagttccctctcggtgtacgcttcatcactcattctcttccttgtactcgtctcgcttcc

SEQ ID NO: 4250 - DNA, 2000 bp, Arabidopsis thaliana
ttataatatatatactcacatatatacattatatatatgaattatatgcatgttcgtagttatatcttgcctctactccaaatatttattatacattgacatgttgctaggacaacctcaacgtgaaacttttgctgataaattgattgatgatgctcgtatagacgatatgacgttcttagcatatgatttcgtatatggtgacataattcatgaataatatcaacatttggtgtcaaaaggaaacatatttcttgtcttcttcttcaacgtacttgcttataatgaacaaaaaataaaaaaacgtactcgctttctaataagtatcacataggtttaggctcataaacatatggactaacataaataaaccaaaagcccaataacattactcttagcatatacatataagtaaactattaacatctgtctgcgggactcgttgatttcatttaaattctgtagtctcagctcgttcaatttaatctattcgtacacactgataatattcaagaaaacatatgctaacgtataacgtattacgtatccaaatacaccttacaccactcacacatagcccatatataaaagtttgaaggatttaaagtcgcagactcgcggtcattttttttctttaaagtcgcagtcattgactgactgattcttctttcttattgaaaggttttttatgtaaagacgaaagtttaatcaggatgtgaatatggtacggcccatgttctttattcctttttttttttttggtgcaaagttctttcttattctatgttagaaaaataatcaaattaccgacgcgagcaaaggttattatttcctggctattagtctataactgataaataattagtcaatcagatcaaacaatagagaaataattagtctgcaatcagcgattattaaaaaataaaataaaatagaaacatatctcagcaccgatttttcaacagccggcccacgatccagaaccgtccagcttgaagccggcgccgcgtcgacttgttccaccgttcggatattgccacgtgtgtgagagacacctgccattacctcgtggaacatgttttgttagtataagttactaaccaagtcgctatcttcaattcttcattacctaagagttgaataaaaaaacaaccatatacgatgagacacgcaaataactgatatacgaaacaattatttattgatgtacattcttctaactataatactacaagattctgaatagttttagatgtaaaaagtacgagaagagttatgatcagagtaagttaagtgataagatcatgacacgtaggcagaggaaataaagtagaaactatcgacaacataataattgagtgagtacaaaaaccacgtaataattaggtgtacactgtagtctgtagatcgattgtacaaaatgaaaaaactatatgatttaaggaactagatatacatatgcatcgactcaagaacagttgctttatgtgaagactatcaattacattatcggctaaatttggcttcatgtgttgaatagatggattgtgtgctcaggtagttgtgtcagttaattataacagtaaaccttcactgcttcacatatataaaatttgggttaaaaaaactttaacattttatttttttaattgacaacaaacaaattctgtaacggttacatataatagtgcttcagttaaactccttttttaggcaactctaattcctttatacccttaatccattattattctatcgaacttatctttttaaaagcttccgcgttacgccatcacttctccaccatttaaatacctaaaccactttctttcaaatttcttattccataaaaagtaaattcacaacaaaaccaaaaaaaaaaaaagagaagaagaattagcttacgtgttcatcacatctgcattacgcgcaaacgaaacagattcaaattctccggcgaagttttcttattcatcaatcaatctctggattcatcaatc

SEQ ID NO: 4251 - DNA, 2000 bp, Arabidopsis thaliana
agctctttacatactcttcctcaatcactcgtaaaattgaacaaaaaaatttcaaatcccccgtttcaaggaaattatttaatattctttcatccttatttcaaactcactatataaattaaaatattgcttatttataagctcattatacaaattccatatagattctcgtccctttgattaataaacgtcaactaattaacggtaataacttattatatagtaccttacaaatctctagattggtggtccaacggtatttggatcaacaccattgaaataatttagtttattgccgatttaaagtagattaattatcctaatgacaaatatgattttttttttcttctttttgtcatcacaaatatgaattggtatcctcattggcctgattaacatttctaattacggatcttacctcttcgtgccaaagaagacatttggaaatatatgacccccataaaccaaatatatgtttcttattaatgttgtggaatttgggacattttttaaaatggacaaaagaagacagaaacaattttcctacccaaaatggcgtccttaattttttcattaaattgtaaagcctgtttcaaaagaaaattgactttttgttgtgatagtataaaaaatgacatttgactttttaagtgacaccaagattctgacaataacgaattatatccatgctaattaattgatagcttaattaacaattgcgcaacataacgtgatcaaattaattaagctacatatcaggccttgatccgtggtccaaataatcatcctactaaagaaaaccagcttgttatagtaaaaagccgaattcgtgtaaaaatcggtttaaaatattcggtatagactctaatctcgatttactccggtttggttatcgtgtgtgtgatcgtaacttgccggtggatttgcgacggacacgtgggatgttgtaattgtctcacgtgactcatcgtaactacctttaaattcgctactgtgattttccagattcttatgtacatttgtgacttcttcggtctatttttgttatgtttccaaaaagacatgaatgaagaaacattattacagtttcttttcttcccttaagcctatttaaaattgatatttctaaattcgaactatttattcactagtcgaagccttttaacgcaaatctgagctcttaagtggcgcaaaaaccggtttaatatgtaaatagtaactcggtttagattaatttcgggttatttttgtgattagtgtagttaactaattaattcaggtgaataattatattagagagaaataaatttcaggacaaaaaggcaaagctttggtactgtctcttctcttctccgtcttcttcaccatttcgaaaaatctcaaaactttacagagagaaagagagatcctttacatatacttcactgtcttcttgaaaaccctaatcctccgatctgtttaacctccgatcaagagagatttcttcagcttgtgtgtatcagattcctttggattccccgattcttcgtcgtatcgaatcgggggatggcatttccgtgaaatcagtgatgaaattggaggtgagaagaagttatttctatctatgggcgtagtagctgaggtttggaggtcgagcgtgaggctattaacgaactcgcctcagcttaacggtggctctcacaagagtgcgttatggaagtggcgatttttctctgctcagcccaaaagaaccgtaatgtggacatgggtttgtggtttcatgcttttctctttaggagtcatctcacttttcactggtcacgttgtctcgcaccttgagtggtattctcagcaattaagcaaacggagcttactggtaccttttagcttacttagtgtttcgtttgttacttcttctgctcaattttgtaaccaagtagtgaaattggatgttattcttcaggatatgagccgtcgagaaccaattgatgtatggaagtcaaaatattcgaagtttttct

SEQ ID NO: 4252 - DNA, 2000 bp, Arabidopsis thaliana
taatcgtatcttttaattcacacatgcacatatacatgaaaagtaaataacttaattggaaacattttttttttgataaatgtatcgtaattttaatttggttatcttacctgttaccaacataaaatgaggacacgttatgatttttttttattttttttttaatgatttgttttagtatataaatattttgattttcatggccaaacatatagcacagttcttattagttattacgcgcaagataacacaattatttgtttatctttagcacatactcgaagtcgaagatcctcaactgagatcaagtttagtcaaatatttaagaagaagctataaacattacgtactattatagacttaaaaaaaattcgtacatgattacaccaataagttaactgcacatcctcgatttaaagaatgtcatttgatgataagatttatcagataacgtgtctttttaaaacactaaaaaaagagagaaaaaaatacttggggtgtatgtattgttaaacaagcattatcttgtttgcgatttatctatttctgaacatcattttctttgagtcaaatgtctaatgtttgaagtttgaacatataaatacgtattacaagatgatacacaatataattaaggaataaataaattaaattttgatgaactctaatttccattttattttggttacccaaaatggtaaagtacgagaccacatgatagagatagaacagtgtactttgaccttaattatgcttttttttaaacgaagttaaaaaatctcacaaggtcaaagctggaaaaatgaagttttgttcttcaaagagaatttacctgggcttgaagtcctagcggcaaagccggcagcgaagtttttgtccaatttatttatttattctaataatttatactccacattatatatgttaataaaaataacaacacaaatcaattgtgtttctgtaatatttttaacaaattaaaaatacagttactattccttttttttattcttccctatttcatctataggaatataaacttgtaaataattttttggtatttttattttttgacagccttgtatagaaatttaaatatacgtaaataaattaggtaatgtccccaaaagacagagacagttttagtataatacaatttcaatacaatgacataaagtttaattatataatttttaaaaacgctaattatatttttaattaaatctctcaatcctcgtcgttgtcgtaatcatatatcccctccccagttcttcttccctctctctctctttcaccataacaaaaaaactgatttgtttactctgttaatcagagaactttctctgagaaaataacaggaattcagttagttcttagttcctatcaatcaccagctgaataaattcgtttttaaaagagaacgaagaaattcaaaaaacccaattctgctttttcccgataacttcgatcgtcttcgcttgggttttgtgtaatttgagtctgtgaattgaaccgagccccaccaaagtaaatgctccataacgttgaaaacattttcttctttatacaagaatttcaaattgtttcactttctccataggggtttttggggttctctgtttttctttgacgaattttgattttgcaaattcaggaaaaaagtttaaacctttaatcgtttgtttaaaggatcgattttttaatttcttactcaaattgggatgcagtacataagtagatgtttgcctttttgtgtaaactttgtgaattttcaatgtttatttctcctttagggatttgtaggttctctgttaattgagaatttcgaatccaccaaattggaattgaaacgtggtgattccaaattcgaggttatattcaggttttgggttaggtgaagatctgggtttgaagttatagaggggatttagggttctgggtttatagcaacaaaagggttttgtgttttagaatcaaagataagattgagaaagtaagaa

SEQ ID NO: 4253 - DNA, 1983 bp, Arabidopsis thaliana
tcatcactgatcggtcggaccactttacctcatgttatcaaagaattatgatctacgatacgtgagatgcttgctagtttacattcctactcatgtaatattattgtaataaagcttcgtttaatcatcaatgctctatagttataataaattttggttactataaagaaaatttctatttatctgttccttactttcttctacttgaagaacatattacaacttcttttactttaagattttgtaacaataaaataaagctgggataatagacgtacgcaattaattgcacagcctattgatgtgtcaatcacagagaaattgcttccgctcaccagctttggtagattcgctaataaaaatgaaattgaaattgtttgtgacatcactctgctcaacaaagctagtggtttggatgtcggtgttctagtccctgatgataatgaggatattctgatcatctctttctccttggaaaaattccgatctcccttggcgtttgtacctcttccaagactaagagctaaagaagaagaactcactctattgtctcactatggtaactggaccagacgatccatgcatccctaagaaggaggacaaagaacaaaggtaaatgaggtaacaaaggtgaaatgtaaaggtgaaggaggtaataaaagtaaaggaggtaacaaaggcaaatgtaacggattaatattcatagaaaagacatagacaaaagacatttatatgtacacatttttcttttggtttcttttttttttccatgtagttgaggatcctatctcaagatctgaagacatgaatctggttcatgtgacattcatataaatatatgacaaacgatatgatgctgaagaagaaactgtcatgttatgtcaagttctgaaatcagcaaattcaaacaacacaaacacaagtatgaaacaaaaccaactgaatgatcaactgaacagatcatctatgtttgctgccgaagtttccatacttactctcaggtactgaaattgagcctttgcgtgtgagataacctcaacagtgtgactgagagattttcaagggtaaatagaacttgaaaatgttagctaaaaagaaagctaaaaattactaaaaaacaaggacaaaagataaatagtaactctggccattaagagtatgtatcataaaatcacaatagaccatttttaatctaattttagatatttttttatttaatagaatgcaatatgcgaatttgaattgtactatcacactagattacataacctagttgaacttctaaatatcttacgtacaatttttttttttggttttggttacatagtagtatgtattacacattttcattattttaatacgtacaaaagcttttaaacatgtatgaatcaggtggagtatttgactacgctttgttcaacttgtctgagtctaaactgtgtgtggtaaggacgtaatgcacttaacttagttttttaatctgttcaacgaaaggcttttgatcaaggagcccgatatttaagagggaaaaaaacgtgaccaataatacaataaaatggaaaacaatgtattcgcaacgtgatcaaatgaatattaaacacagtcaaaagtctacatgctgacatgcacaacctcgattttaatatctccctctctctctctccttgctgcatgttaattattttagatctagatctattgcgtaaatgagctgttacctaaattatttgtattattgttatttgtttagtatagtttctttggaagattctcatcagttctttaagaaatactcttctctaagcctatttataccccgacccattttcactttgaatcaccattaaaccaggtctttagtacaaaacttcaaacaaaaggtcaaaagctaatttcttttttttgctaagaaaaactaatttcttcctcttcgacctctcaagcatcattagataaacaaatcctattcccgtcatggcagca

SEQ ID NO: 4254 - DNA, 1294 bp, Arabidopsis thaliana
tttcttacattcttctttccatgcaccgtactgctcccttagatgatcaataacatttaaagttagccatgacgtgcatctacaaaactagtaaatgatcaaccaattctatagtaccttctgcgattcctcagtatgttcctttcctcaaaagtgctgtctggatcgtagcatcctaacaaaaactcccaaacagcgcctttgatggaaggatgaattccctagcaaagaaaccaagtgaacaacaacaaaaagagcatatagatagaaacaagatcaggaaaagaaagtagactcactccgcgctgtatacgtctaagcactttttccatatccaaatggccatcttcagtaaaggcagcgtgccatcttctagcacttagagtctttccagcctgacaaattacatatcaagatgaatcatttcatcagctacaaacaaacaaacaagaacctaatgtatcatcaattcatcaagacatgaaacaggtgattgagaagaagaatggtacccttgatttaaaacgggtcctgggaacatctggttgacattcaggtctaactggatagaaaccttgcaaatcttctcctccggatttccacataaatccgcagcaaaacattcaaccttccttcttcttgttcaaaccaaacttatagtttcatccatctcccacataaatcattcatggattcatcagaccactgttcaagaaataaaacccaggatcagaatggagaaaaaatgaaaactttacaaatatgtaaacgaaaacacaaggaagatatattctttttgcaacgacgaagctcccattgctcaataatatatataaccttaaaatcagtatcagaacaccatcatcattatcatttggataatccagaaaccgattagacccaacaatttgaaattgtctacagagagaatacgaacaaaagaaaaatacatacagattgagatcctaaacagccggaatcttcagagacatgcccgtcttcttcttccatctttcatctttcatctttctatttctagcagagtactttcctttttaaccgaaccaagccgattttattagctccgatttcaaacattaaaccgatcggtttcggtattcttaaacgacgtcatgtaatctctccacatttaatgggcctttaaaattgttagtgggcttctatatgcttatgtgcctaattcttttatatcaaaaaccctaataatctcttgggcacataaaaatctcttcgccgcacaattgctccaatctgtttcttctagccggccaaa

SEQ ID NO: 4255 - DNA, 1390 bp, Arabidopsis thaliana
gagtgtaagagtcctcgaagagatttgctgaaagaagcttccgacgaagagaagattacgatgttatcagggcgtacgtatgtatgtgtgtttgaccttttcttgttacagtctaaaataccttagattattgagaattatgtatagtttatatttcttaatggcgaatgcatacattctttgtttatggatttttttttataggagtttacttccaataccaatttgaagaaggaattgtgtatattcctattcattgagggaaaaacaatgtattatttttatacatattaggatcatgcataaaattgtgtatttgaattacgttaactctctattgaccattgttgagtagagtgacaccaatagagaattttctttttcatttaaaacctctcttcttaatgttatcttcttttgagtccttgttctcattaactttgtttttcttaagcaaattataaattattttttcttttattataaaacgacgtctattatattctataaggaagccaaaccaacacaagtctaagaatgttttgtttgtacgcagaaaaatgttagactacagttttattattcataattcatagtactaaagtaattttttgaagaatgattttctttaataaggtatcatcaacatatactaccaaaaatatttaatttatcccactaattttgaaggcatcacgattaataatacgtgcttaaaatcttaattccgtaataatgctacacttttgagaaatttgttaagtttatgatagtttgtatgatagccatcttttgactgatctagtcggacataaccaaacacccatttactgttattatcatctggaaacccaatgagaagataagagttttatgaagcacacaagtgagaaacaaaaataaggaacatatttggttggatctatcattaaaccaaagatagataagagggaaacgaaactggagtaataatcaaaatacaatctaccatgtagatagggaaaatactcggtggttttagttgaaaaatgtaaatagttgaaagttatcaaaattttctaatatttaaacaccaaagttgaccaagatggcaaaaaggcaagaaacaagaaaatgaaagacaactatcgttatgatacaaatttgaccaaaatgaagatatgataatgtttccaaaattctcgatgcaagtagttcgctcaattatttgataagaatgatttccccactagctcaataaaaaacaattaatccttgtacgcaagttatcatagtgaagcattgacactgtgacccttggcattataaattacgaatttaagataaagaagagaagaatcaagcaaaagttgtgtttctcataaagatctcaaagatattcctactacac

SEQ ID NO: 4256 - DNA, 2000 bp, Arabidopsis thaliana
aagacaatcatgaacataaatggtcattgataacaaattaggcctggagtactgctaacaaaaaaatggtcaagcccatacagtagatttattaggcccaataagatccaacagagattagtctgattgcttcaactatgagtctatgacagcgacttgactttctgctgcaccattattttaaaattgtgttgtgtggtctccctttggccacatgatggcttaaaatgaatggtctctcccggtaatggatgctctttgcttttactttgttttgtcaccacacaatgctcatcatctaattggagttggtaatcaccaattaattgaaactcttgctaattatgatatagaggacaacacatccttttcgtcaatcacttttacgccttccctttttggacatttatttcttctattttaaaaattccacggcaatttcatattatatcagtggtaatggttttggtctttgcttaattaatgtgttaatcaactttcttaatcccaacttgttttgtttttttttatcagtcggtggattctcatatcttttggacggcgaaatagagacttcttttctcccactttctctatttaaatataagtataaacccaaacttatcattatatattatgcaaaattaatacgttgacagcgccgtttaccatttttataatactgactaaatgttacttatccttcactctttcgtttatgtttccttcatgatggtcatgtttatcctttgttattcatcatgtacattaaaagtaatgttcgattcaaattactgtagatgcgcacgtttcacttattttattgtgacctctaaaaaaaacaagaatatataccaatataccattttattagttggtaaaagatagaaatactaattttgaaaataaaaatttaaccatttccccaaataaatgatatataagaaaatttgtagcttatgctttaaccaatttacaaataatattcccgaaaattctgatgttgtttagtccgctgtttaagtagttgcttgctatcttattttaaaattttggagtatattttaataaggtagaaaccgtagatatgacatgattattggggggtccgaaacatataaaatatggaaggtggtgagacaacaagttagcgaggatcgtgcaaaatcttcatcatcagatcaacaaattgtttttcaataagaaaaaatattcatcttaagctattataaatttggtccattttcataaaataataaaaggtaaacaatgcatgtgtacacaaaagttaacttaatattatatattaaatatctcaaatatttctctacttaaaataaattttaaataattttagtttcatgtttaattttgggttttgcaaaaaataccacaaaagaaagacactgaaagtgaaaactaacggggaattgtgggcatagacggcaaaatggaggggtctgaattaaaaaagagagagaaataagtgacgtttggtttgtaatataaaatcagatctgtaaaataccagatcacgtgtataaaaagatttggtatttattactactaacttcatttgatctaaattacataatcgtcagactggtaataaaaattgacaaaaataggtggtcaaaataataataaaaatctttgtattcttctgtattttgtaaaaaaatataccaaatcgattaatatatgcaacataataatgatttcgtaccataatatagcttgaaataaaataaaaaatcaactatacatccactttatatattttaaattaaattgtatggaaaagtatcttaaataattaatttcctttagtaataaaccaaaattaaaagtctaattgacagtttagtaatgaaattaataaaaggtgaaagtaaaggaacacaataatgtgtataggttaagcaaagacagctatatatatagaaaacagagagagaagaagaagaagaagaagaagaagaagaagaagaagaagaaag

SEQ ID NO: 4257 - DNA, 1768 bp, Arabidopsis thaliana
tccctccagagtccaggggttgattatgtattttgggctaacaaatattaaaaaaatggattgttaaggcccaacttaagcccagaaataaattcagtcagtggattcatataatcgcgtggactctttcttccaaatgatttacataaagagtcaaaagtccttgaacttcacgtacgaagacttgtcaaaaggcataattaaaacggacaacgaaactattcacttattaagcttggccgccaagttataatgtcactttccaaaaaagagacgtgtacaaagaagattcagtgactttcttcaccatccccttatatatacattatctgacatgtatagtaagctcaaattaacttaagaactcacacttaagttttaaacctccaaggatgtctctcttcacgctcttcttcgcttgctttgttccaaaatctggttcaaggattaacacaaccgacagtaatttggaagtcttgtctttgaagaaacccaaaagaaaaaccgagtccataagaactcctactatcgtcgtctcttattttcccgtaggctccaacctttctcgtctataggaactaggaagtaggaaggataaaagtgaaattctgtagttatgatcacaaccaagaaaatatatgaggctgatactattgatccagtccaatcttgtttatctatgtaatagaccaatgaaagattctgcttgtggtcgacacttttttgtaatgatgattttgttttgggtaagtttatgtatatacagtggcacagagacagaataactatttattgatataaatattattttttagtcaaaactttcttacttaattgaaaatgaaataaaatatttagcagcaaattatatcttataaactcacatgcttactcatatcttgtaatcgttttatcatttgcttcgttttatgcagtgttaataacatttgcaacggcaaatcgtcttttgagtaaaacatgtattgattctaacgattatagtacaaacagaaaatatgtttactcaattgctatatcagggtcagttgcggagtggtttgtttaaaaaccactctaccactataaatatttgtaaaatgatgtcattaattttttttataattatgctttacaagctttagttttggaccggcctgactttaggccaagattcaaattaatagaaaacctcgcacttaagttttacaactccaaacatgtctctcttcacacccttcttggcttgctttgtccaaaaatctgattcacgggttaacacaaccgacgctaacttgaaaatcttgcctttcaagaaaccgaaaagcaaaaccaagtctccaagagctcccacgatcgtcgtctcttactttccaataggatccaacctttcccgtttatagaaatacgaagatgaaagttaaattttgtaggtatttaaattatacctaaaattggtaaaaataaaaatatactatactgttacagttaaattttggtcatgtctacgtatgtacctagagccgaataaaatattgaaccgggccttaatatttcctaaacactaatgtgtttctctcgtcgacacttactttcaaatgtgacccagactcaagctatgtagagcccacttacctgctgctgcgctggaaatatgcgagacagctttgttcatataatctattttatatatctttcattattataagactcctctccaaatgctaccacacaattcctctatcaaagccgcccaatcctccacccaaaa

SEQ ID NO: 4258 - DNA, 2000 bp, Arabidopsis thaliana
ttatagggaacccaaagatttcaattaaaaaaataatcaaatcaattgaggaaattagctcttaaaattttcgtttgaatcaattgagcagattagctctcaatcagaattcgtttgaatcccaaaattcgttcgattcgagaaacccagaattcgtttgataatctcgtcattatcaatctctcaaatttaagaaataagcttagatttacctaattcatttgaatcaagctcgaaacccagaattcgtttcaaattcgcgatcttatctcaccacattctcttgcttctcagcctcaccaacccttctctttacagtttgatcggacttttatagagaaaatgatgaaaattattaatgagattaggttgtcaacgtctctgcaacaatgaaatcggaaaagaaaaaagattttgcaataaaattttagaaaactgtgaaaggtgtgaagggtgaaaacgtcaaacgacgaaaatataaatacctaaatctataagccatatgagatgtacctattttcacaaaaacatagacttaattgtaccaatcccataattgatccataaaattttagtatattttataatttttccataaaatgagttcattaataggatcgcacaaagttcaaaagagtagttggatttggatatgttggtatcagtttgtttcactttcagcttgtagtatttttctaacaaaggtcccacgatcaaatgagaaatctcattcttgtatataatcattataatttaaaagatccaggtaggctttcattatagtgtgtatataaatatatcacatcggcacatacaaaaactaatatattctggatacacaaaatattagagagcaaagacattggtaataaatcttatttgaaaatttgatatggcgtgtccacaaaatctttcttcttactagagattagcgatccacaacaattagttcaaagattagcgatcccctaattcattttgattgtgtttggaagcgtggagagaaaaattgtattcgaagcattaaattattttcttgccaatagattatgagttaccacttattaccaattgattttgagttgaaattccttataaaatttgatttaagctttagatgagatgtgtgtttgtgtctacggtgcactcgaaatcagaatatattcatttctaccatcgttcatgatagctcgggcattcgaactcttaatgccctaaaaatttattttcttcatctatttattatgttggatttagtgtgttcgatgtgttttgaatgagcgatacacatgtgtaccatcatttacggaaacttgaacgtttggagtgattgattaggtaagaatcctagaacaaaatgactactacaagtaacttttttgcaaaaaccttattttatgtatttcatcttaatactaataacaacttgacttttgttctaccttttcaatttcttattcactacaattttattacaccacactaatcacaagattcacaactaatggtgtatgaaccgttgtttgtgcttcaaactttgcagcgaatattcaaactttttatctatagaaaaagaagagtgtgggggcattaaaaggagctgtctcatagttggtaatgtcaattaagaagctggcaatacaatacatgtaggacaattcaatcatcgacccatttgaatagataatgcaacccaattatttcaccttattacaaagaaaaaaatacaccccaaaatatctcatcaataagcatattatactcatgatgacttttgttaattataaaaactaatgatgctaataaccaaaatcaagagttgataaaggaagtcacgtttggagattctgtctatagtgtttcgctggaggcgttgaaacagccctctttaacagctcacttcgtttcacattcctaaattcctctcaatcttcttcttacttaacttattatataagtctctgtttctctctgacaaaaatattccaccacaaaaaaaa

SEQ ID NO: 4259 - DNA, 2000 bp, Arabidopsis thaliana
tagatatcgggtagattttcattttccgacttcatgcatgatttagttcttaaaacttgcatgtttggcttctactaagacaaccctcgtttttctgacgactcacgtggtcaaacggtgcacaaaggtcacgtgaggcacgtgcgttctactgtttaaacgcctcttctcttttgcttcttttttgccaatttgaaagagataagaatacaaattaaaaagatgtttcttccactttcctcatcgccgttctatgctcactttctttggtcggatttccaattacattgttaactattagtggtcacataattttttcatgacgtggatcacacttctctttttacatgtctatctccttaattagtatctttaattgctttcgacatcaaaagctaatatctatgttttacactctattagttgtttaatattcacaatattcaatatcaaatctcaccgtatttggaaaatgtttattagttcagtacatgacacactcgtaatcaacattttgaattttttaaaatgttttatttgttcagtacatgacacactcgtacatttcgaattgcttactttttttgctttaacaacgtccaagtacaaaggagattctctaagactacaggatttgactttttaccagagaatctatcaggttaaaaacgatacacacacacacacacaaatttacaaaaacaactctagtctctctacttctaaaagtttaataatttgtttttaactttgaactacaaacgaactccatttattgtttcttggatcacgttaagtaacgtggcagctgaacgttgacctatgactcaaagtgagtcccactctaactatcatcttgacggctcagagttctccacgagtgtgaagtgtcaatcggaggagggggtaaaaccgtaaaagcttccgacacgtcccacgaaaaaggataatacgagaaggctcttctcatcatccaacggctcacgatttaacaagactagtctcgcttctgtctcttctcatacccgtcgatctgtcttggcttttcagctatcgccacctcttctctcttttttgcttatctcttcaattttcggatttaaattttacgaaaaacaaagaattaggataatactatttgtctctctaattctgaccataattaatttttattttcatatttgacttttacaaattcaagtgtgggagttcctttattcttgttgtatcactctcaatgcttaactagatttgacatccacatatgtgtttgtccgcttattatacatatgatgatatgaaaatatatcaatcattatatcattcgtaagctgaaaaattagtatgctatttttttctatgtcgaaacgtaattatttatgaccatatttgaacaataatatcgcattttcaccttttatttttaaccttttaagactttccttttaggtcttctagatgcacactggacagacacgcatattcaagatacgtgtgtttttggaggacttcaaaaaaaaaaaacgagataatgattttcccaaattacataaagaagaaaacaaattgattttcccaaataaaggagtcagaaaaatataatttaggaacaaacaaaaaagatacctttaataataaacaaaaataactctaaaaatattttaaaatgaaattcgtatgaaatataaaccgcataaacttatcgtgaccgccttcaaataaaaataaaaccctttattttctctctttcagccgccgctttcacttacctcttcctcttccttcttcttcttctaccttcttctcgtaaaggttttgctacacactggagctcgcaaatctggctatcgaaaaccacaatcacaaactcaacttcggggccttcaaggccaatcacaagaaagtcatggtgagtcttatttttaattctttttgtttgtttttaccttgctatcaatcttctccagattctgatttggtttcgttttgttcagggacca

SEQ ID NO: 4260 - DNA, 2000 bp, Arabidopsis thaliana
gttttatttatatatatggaaggtattgactgcagggaaaatctctgatgttgtaagctatagggatttattctgctctcagcttctcgtccgatccatgcattaaatgcggtggtctcttgtcgaaaatcagtcgagatcttttgcttttcctgtttatggtgctcactttggatcgtgttttcttctagttgaaatataattatgggatacatgcttgtgttgtgttacatatgccatgagcttaatggttacaatgctagttagaacatgtttgtcctgtaaatcaatgttaaaaatatcaacgccgaagaagtcttcttctggcaagtctcactctttgctacagcctacagtgcatgtttgagtgatgaagcaggcagtttttctggtgagttctttgggatatgcataagaggctactctagtgtgtggttcttagacatgatactggcatgctcaacacttcactgcacaacttatggcatactttcaacaagtttcgatatgtaattctttgctctgtcttcagatgaactgatctttacatgttcctgcttttctctttacagaattcaaacaggaaaatcggcgaaaaggcagaacaaaaacaaatcagcattttgcttatgagcaggaagaagatgtcacagaaaagtagagcatgctacatgtgcttacagtgtaagcttccaacttcatcttctttttgtagaactacagagatcaaaacattgcaattaaatggattgaatacttaagatctgagatttaggaattaatttaggatctcctttttctggaacgttctactttacatgtaattataacaaggattaggtttcgtttgagagaattatccaatctggaaagtgctttagaggctaggccaatggggtttaccagacctggtcaagcccttccaaacctatgcctctcttctttatggtaccagctctttgtttcatcgatagacttgatttgacttgtattgttatggccatatgggatattagaatgataggagaaagggatgaaaaatgttgcatttggcgattagagtcgtattataacatgatggtgtcaccggataaatcttcgttttcaggtacattgataactcttcttgagtgagctataactagttcctatcccgtgatcagtgaaacgagaagacgccaggtaaattacagataatgttatttctcaagacctgacatatatagtattagataaaccacatttgggatgttctacttcttactgtcttagaagcttaggcaagacaaaccagaaaaagtggaacttgtgtaactaataaatccataactagctgttcttgctaatgaaagtatcagagattcataatatcctaaacccaaaacatatatgttacatttcaactcagaaatcttgtttgatcctcctatagaggctctggcaaaacctgcacaagcgtaaaaaggatcaaatacgtcccaagtaagaggaatataagatccgaaaattgtgagaagagtattgagattggttagtaccttgcttgttgaatctgtaactgcaatgtctaagtcacaatatcataaccagaaacatcttcaactattatattagattgaatatacgaacaaagtcttgtaatagcaagaggagaacatgacttcaagaagatcgaattggtcctgacataatgttaaacaatgtcgtgttacaaaactgtctctggaaacagtaactgcaattataactatcttgaaaattgtctctacatagatacacacgtaatctgagaattgttggctccaaataaccacaaacgtggactcatgtgtaaccactagttttctcgagactctcaaccatccaccgtcccatgtcgtaattatgcgaatgtgaccttttatcaatcaagatccaactacattcatggatttgatttcttttcccaaactttaacattttatatctaaaaccatttcatcttatgaatatcaacaaca

SEQ ID NO: 4261 - DNA, 557 bp, Arabidopsis thaliana
cccaatagaatagaagagagaaagattttcaaggcaacagctgaactcaaaactgacaaaaggtaatcgaagattcttctgatcctggctccgctctattagaatcgatgatttgagggagaagttcttaagcccaatttgacgggacggcgttaattacggcgagcaaagtattatccaaaaacgacctcctaaaaaagagaacagagagttttttttgaggattgaggtatgaggtatctaattgaaagacgcaaaagtaatactataaggaaaaaaaaaaaagagcatgtttatggacctaataatattcgtctgggtcggatcatttgatttggttgcctactaattatccgaatgagacgaaaatgaaatttgaatgaatgggccctatccgagcataaaatccgagtaattcgggtcgggtttgggtattccataaaaagcaactctcacaccaatccgttgctcaatcctctctctctctctctcagctgccttcgcgccggcgaagtttgtctctgtgaaaacagagagtggtagtgagagcgtgagaa

SEQ ID NO: 4262 - DNA, 2000 bp, Arabidopsis thaliana
aaaacctagtggggtttttttttgtgtgtacatgaaaagtggtaaaagtattttctcttttttaattttgttagattaaaaatatgttaaggtagcttgttttgtttatcgtcatgtgttaaagtgtactatatggtaaagatttatacagtagcatgtgtaagcgggttcatgagtaggagagaattaaattctgccttaattaaacaaaggtttcgattagccgtacgtaccgccattaatagggagcataattatcacccattagggagcatactttgaccactaggggaaaattagaaacctatggtaatcgtattaattaatacggccaaaattaattctaattaacatataaaactgtttcccacaactaatttttatagatatatcaccttttagataaaatatagaaattctttcttcatatatatgttactaacaaataaaaatcataccgatgcaatgacctacaatctgaccggttagctcaacaactcagtatttgagaaatgtaattttgttcgattaccataggtttttatttgtataaatctaaatataatcatattacttctttttttatcgaaatataatcatattaactcacgcgaagaaactataataatccatctgacttctggttcgtaaatattgtcatacttaattagagacgaattgttctcatggtaatcagcaaaagatcgaatttcctaatttctaatactagtccagaaatatggtatagatttttatcataattttttttgtctagatataataaagtgtaaatggatagccacccacccactcctctcgtataatgtaaatttctcatttttttaatgatgccaaatccatataatcggaatttcaaccaccgtatttgggctatagatcataactaaagttatggaaataaatgaataaattaaaaaatgttaagtagaaaaaataagtatcaacaagagagaaggaagaagaagacataagctaacagttgtccgaaattgattttggcaaaaggtgatctttgattttgcttaaaacatcgaatcagaacatttaatttagttgtttcctcatttctttcatctatggagtttagtatacccaataaatttgattagttacttattccagctcctattattatatttaacacacataatgtaaaacagacgcgtataatttatatagaaactgtatgtagttaaaaacgacatactagtactgatgactctttgtttacgtaaatttgtattctcaaagaaaaaaagtaactaccttttgttatggtctctaagaaaaaacaaaagtactttacagttttcttagtgaccattctgtaagaatatcaaatagtgaaaaataggtaaacgagaatctttttttctgtgtaacaatattgtattagtgaaggattattaattacgagactattatctaaaacgcattagtgacccttttggatttaaatcgtagcagccgactaaaccaaaatatttagaaagttttccaaaaacaaacaacattaaaacacatttaaactcgtacacaataatagaaactaaactatttttagcagactaaagtctaaacaacattacgtttaaaaattgataatcagtgttttatagaactggcgatctcctaaagatgaaccaccgagaagtttcaagataaaaacaaaaataaaaatagccaaacactcttatctattcatccatttgcaggtcaatgacaccgtatttttccacaatcgaatcttccttattctttacacaaacttcttctctgtatgtaagtaaactaatattaaaattgaacttgtcaaagactttcctcttggtcacgtctgctatatatactccttcattcacacaaatgtttaactccaacacacttctctttctctcaacctctctccctctctctctccgattgtgtttttagagctgtcacgtgtcacgtgtcaggttcgaagctctaagaaaaaa

SEQ ID NO: 4263 - DNA, 778 bp, Arabidopsis thaliana
ttatcttcgatcatctaagttatgtgtggttgaatgtttaaaaaaaatatccgaggtgttgtttccagggtttaaaaagaaagcctggtttacacgtttgtgatgatgtttttgtttgtgtttttttgaagttgttcttcatgaggtaaaaagaaaaaaaagtgtttgtaaaaatctcttttgtaatgatatctcttcgttttctttggatgttttgattacacttgatttgttgtgtgatattgggcgaaagatgtggtctatgcagttcaacgtctacgaattttaaccccaacatgaccaaaacactcatatttgtagttcttagatgtaaatttttactgcataacccatcttttccaaaatgtttgtcaaacgtaaattagcatttttgtccgcaagatacaatgactttagcatgaaccaaaagggaaataaatctcaatcaaccaccgtattaattattttccgaaattcatatgtgaatataggagttgtttagcaattcagaaagaaatactaatcaaggtttataattacagaaatctggaaatgtatgtcggtcacatcagaaggaaaactgaaagagatatttcttgaatcttcttcttcacatatattttgtcacattgtatagaaaaagattgttcacttccgctacttaacggtcaagacaacgaccaaggccaccaggccccttcacttcttttatcttcgaaaaccaaaattttcaattatttattctctcctccactcacacgaaagtagcaaaagcaaa

SEQ ID NO: 4264 - DNA, 2000 bp, Arabidopsis thaliana
gacttttcaaagaaacaaaaaatttatgaagttttttctattttggaaaattttctactccctccgtcctactaagataatatttttaaaaaatttcacattctttaaaaaatattgtataatgacaattttaacctcttaataaactttaaaaataataataaatatttagctaattatttaataaaggtaaaacaggtaaatagttttaaaatttgcattgaaaatataaaacttctatctttgtgggacaaatattttttctagaaaatttatctttgtgggacaaagggagcataagttatctaacaaatatgttattttcttttaggaattttgtgcaaaaaaaacccgttcaaaatcacctattttttttcaaatttaccttcaacgtccaataaatgcaaaataatcatataaattcataaataatatgcaatataacctatttatgaaactttacatatattgtaaacgtttttatggtcacatatacttgtttttgaaaattttaaagatatagttgaactcttcatctcgaaagctacgatttgatatattatttatcaaaatttaaaaattttacaatagcaaaaaagttatattgcgtactatttttaactttatataattattttatagtttttagatataaattgtaaaattgcaaaaatagatgattttgtggatttttttttcagaaaaatcttcttttaatatctctgtttttctactcatctaatttcgttaaaaatgtagtattaatcactacaattttccatttgttcttttgtaaggaaaaacaaaaaaacaaaaaaaaaaaaaaaatcgaatttttaaaaaattattacctaaagtcgaaagtgtctagatgatcagtggttgttcaacaaattgaccttgacaattctccttttcattaaacattttcttacaaacgtactcaagttcttaaacaaaagtagtcctaaaaaaagatatacatccacttgtgtaagaatcaatacttttgttttcttcctcgtagttaagtaatttacatgtatttgcaaaatcgatccccaaagtttgatattactcacactttgtaaccaagaaacaacaatactaatgagacacacgagattattatgcactgggttctctgggtcccactgcttctgcttttgtcggcttgcgttttgtgggtggagaatatatgtcatgagaaacgtatcatctaaccgttagatcaacgacgtctacatatctttcaatacaccgcgtaacactgaaacaaaacctctcttccccactttcttcttcttcttctttctccatagtcatttctaagtccaaccatctgattcttcgacatgaccttttgttcttcttctcttttctctctctcttaaacccaatttgagattgttcgatttcgatctacgagattcttacaagaacataagcagcttcggttttttgggattatcttatttggtcggatgatgatcttctcgatgtctgtgctaggtaaattctttattttattttgtttttgaagttgtattaaattctttaatttagtattaaatgttgaatctttatgcgaatcttgttactgggtcgtctcttaactccgtagtaaatggaacaaatttgccgactttttatgtaatttggttataagattttagcaaatgctttaattttggggttttgtttgtttcaaagtaaagtacttgagtctaaagatcgttggtgaagcataggactaatcaattttgagtctttactaagattgtaattgatatagaaatttcccaaaagtggagacttttagtggttattctgcaacattttattcctaattgttgtttctgtggaatttagtgtgaattcactgtaatgatttggtttttgtttgttttgatttctccttcaggctttgggaattagatatatttggggttaagctcgagtctctccggttttgagtttacttgagtttgttagtattt

SEQ ID NO: 4265 - DNA, 1761 bp, Arabidopsis thaliana
cgtttttggctctaatttttttttataatctaagataatattttgtttgtgtagctttgagattgtgttcctaatatcattcccacatgtatataaataatgtgtattttgtacttacttagagagaaatacatagatgtgaagagagttttatacgttttaataatcattcattatcttatagtgacaaataatgactcttcttcgcttcattgaaatttcagagatgcaatgtccacaagaatcatgcacacttgagccgtttaacgtgtgttgattcagatggatgactatgcgaaagtatagctacaaaatcacctaacagtcaaaatttaaaataattttccaacataaatgtttcgtatcgtggaaagtataactttcttttaaaacaaagacggtgattgcattaactcgtaccaaatcaataccatgggcaacttagagcatgtccaacggttaaggccctaaaaatttctaaaaagacaaaaaaatagattttattttaatagttataatctatttttttaatacagatagaccagtaataaaaatacatgtgttattttgtttgtgagctcgtcccttacttacgggttttaagagtttctctctcatgttcctactaacttttgattattttttactttttttattgttagggcctcacctaaaagcctccggttggggatggtctttaatgcattaactttcaaatcaatatgggattgcattcactttctttttgggtcttcaaaaagttcaaaaacctcaagtaatttccctacttaaattatccttaaaatctgaaaaaagagattaatcaacttcttaaattcttcttatggttttggtttacttttactttttttggcatatgatttatttattaacattgaaaataaaataaaaacaacttaaaaagttgggtttaagtttttttttgagctttaacacttgaagaatgaaatcataagacttttaagttataaaatcgaatatggacttaaatatatccggatatccgttatccggttcaaattctcggattattcgtatctatatctttattcggactatccgtcgttttactatctgcatatgttggccggctatccgtttgtttggataaaaatccgtggtaaaatatattaacctcatgcgtactttggtctactaataattagactataaatattattctaattttttggtgtgttattattggagttgtctcctaccaaacaaaaatgcgaaaagagtcaattttgaattttgatcattttgataaaaagtaaaagaatcgttttattaaatatttttaaatgatctttttttttcaaaatcaatcaaacccgttatatctagatatctattaaccggcctaaattctaggattatttgtatccgtcgtttaactattcgtatatctggccggctatccgtttgtttggttcaaaaaccggatacggatatccacggtttaaatagattaacctcatgcctacctacttttggtattctaataattagactattctaattttctggtgtgctattgttggagttgtctcctaaaaaaaatgcaaagaagagtcaattttgatcatttaaaaatatttaataaaaacaattcctttagtttaattggtatactgggccatcaatgggaccgaccaccaagagttgtgcaagcaatcggattatttagcgtttttgatgagttccagtaatctatttgcttttctcaatagctttaaa

SEQ ID NO: 4266 - DNA, 2000 bp, Arabidopsis thaliana
tgtcctcatatctacgaattgtatgaaagggtttaataaccataatctattgcattgtcctatctacgtacaccataatcgcttgtgttggtggatctatagtaatctaaacaattttttatttccatggcgtgaaagtttgagccaacaactaacgatattaatcgtacaaatgagtttcatatttttttttgcaatctcatttcaaaaagtgaaaccaaaatttggatgcttctaattaaccataagattttttattaggtgcacctaatcttgttaataaattataatcttctttgattagttatgctcctatccagatttcatgcttcaactctatgattgatcaacttgcattattactgtaccataaatactttgccaacgaatgttagttgtgggggaaacaacaattccgctggtaattttgactgaattaaaaaattagagatagaatgcaaggagacacgtacgaacgagttcatacacgagaagcagttgaccagagtcaacaaacctgtaaaaagctaaagaaccaccgtccactcgcagtctactatatacgactaactaagattcatgcaggctcaagtttttgtacttgtatgacacgtggctagatcgtaacggccgtttagactgatgtctcttcgtctctccgagtctttgtcctgtctttttctcattgcatgagacataccgaagattccagtggattaattgtcggtccatttcttttttcctttttactactgacttcgagttagattctctaaagtagtacacgtgaaccataggattcgtttatgattacataaaacctttgttagtagtgtttgttcatttcttaattctggttatacatttgaaacatatgcaaatttatcactcgacttattaatcctaagttcgtaactaagttctttttggttaattagcttatatacttctcaagatttctgattctgacttatgctataaagtatatcttcgataagttgagtcgcatctctctcctcggaaaatattcttgtattttggacaaatttctcgtgtattgttttgatatttttgtggtcatgttgttttgtgaattagtatataagtagataaactacgtagttttcattcgtacaactatataaccaatcgtattcgacgaaataaatagtcagaaaatattctatttgttatgcaataatatctcactatacagtccaaaatattaacctccatataaatctgatagtaacaacaaacaattttttctctttgtcctataacatacataatacatttatgtttgaaagacaagagaagaacaaaaacaagaacccacaaatgtcaaaatagtgaaagaattggattccgacttcgatttcccattacacaaaacgacgtagcaacggacggcgctagctattacgttaagagacgaaaaacggagtagggaccaacaaaaaaacgtgatcatggatggattattaacgatagacattggattacggcgatggacccataaaactgacgtcatccgttatggggtccgtagtgtggtcctctaaaaagtattgacgctttttgtcatctctctgttctttaggactcgtcacaaattttacttcctcagattcacatgaccaaatcatgtaaccattttccaaataaaatctttacatttagatttagattcagaggaattgaattagcctcatcataatgtatgatactacatactacactagtgacacggaaattacacgacgaaaataaacaatgtgaagaataacgaaatttcccgggaaaagagagatagagagtgagacacacgcgcgagtgatgcgtgtggtagtaaatagaacactgtttgatgatactgctgcgactacttaactcttattacaaagctctctttttgttgtctctctcttgctctctctgcaaaactccggcgagaagagaacgttgtcgtttcattcgtatcaaagtcttcatcagca

SEQ ID NO: 4267 - DNA, 855 bp, Arabidopsis thaliana
agttttagtaacttcaatattttctatggtttatgtgtttgctgcgaaggactgtagatttttttatgcctttttttttaaccttagacctcaaagttttatttatttacaattaaggatttgcgactttgctgcttggttgctttatatttcatagtgcaattttggtgaccataatttgtatttattgtctgaaaacttctctagattaagagctaatgtaatatccattcaaacatcggatgaaacctctcctaacatgacaaagattaaaaataaattacatgaattgtgagaactcaagcatctataattctattttcgttgagctcatctatacaactctttctgaagtccaacaaattctaaaataacatgaaaaagtatgatccacaaaaaaagaaagataacataatgaaatcaaaatttttatcggacccacccacctaatctcctcccttcatggcttcatctacccgccacgtttattatatggcatagtaagaatctttttttttttaccatcacaatgtcttaatcgtcatagattgctctctacacatttcatagaaatcaatcctgaaatactctcacgcattgcatacaaacttattcacaaaaaggaagcatcaatttataatgaatcattccttcaaatttaaaaccaaattaacagaagaagagaagaagaagacgaaaaagaagaattgacaagtattctaaaaattataataacttttatccaacatcgtaaataatgagacatgtatataacactatattcacttaacttacataggagacacaatatcaacaacttattgttcctttggttcgaacaattttaccaaaaaa

SEQ ID NO: 4268 - DNA, 748 bp, Arabidopsis thaliana
gttctctttcggccgtttgtaatataagaattgtcgtttttgtccaaaaaaaagggttggctttcagtttgtgtcccagaaacaaagtaaatctttagataaattgaaacaaaactagctttgtgactccaattaaactttgcttcctctaagaaaccttatggagagtattattctacaatgatttgaagtatactactaataattgattacatttaaattcaactataatttattgttattgttcttcaatcaacttgaactttgagtttattgggcacattacttttagaggaatgtgaatgtgaacattgaagagacgtgtattttattttcttcttgacaaataccgttggaggtataaaaacaccatcaaactcaggcccatttggcaatggcggcaacaagaatgggtattatattgaggttaatttcgtcaatcaccacttttaaatcgtgacaaattcgtctattatctctcaatcttcttcaaccttcaattacatcggcaattctacaagtggcagcatcctattagtaacaaacacacgtggcgtaagctaatgcgtcgtagtgtttataatagctggggtttgttaattatggcgtcacgagtgatttaagaagcagctgaaaaataataaacaatgagggaatgccaacgttttaaattatatttttaatttgtgaattttcatcagagtcggatcttgatgcgactgctcaaacagagtcaccggcgattacg

SEQ ID NO: 4269 - DNA, 1895 bp, Arabidopsis thaliana
tcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgaatctcctttgctaagtccttctctcttcgttacgtattttcgatatattatacttattcatgtgctaaaaaaggtgaaaacaagggaaatatgttggaacaacacaaaaggttgcatgaatatatctaaactatgcgaactattatggctattgatagaaacatgaacatttagtagttgattttatggctttgatagttttggcaattgattagaatgttaatctctttatagagaaatagtaagaaaatatgtaaagagaatgtgcatggagctgaaatgacccatatctaataattaggtttcttgtcactttatttatctttttgaaacacattgttcttttaagtacagagaaataataagatgaataatggtaaatatgtaatgtctctccaataatgcgatatgctttattgaccatatcgttccacaacaatccaacataccttcaccacctcatttctaaattccctccttttgtctctttttcacacccccaccgtatcagcttttccctaaagtttcaccaaaattttaaaatattccctcctccatcatatttagtgattttttttctttttgatatttattaaagttagtttatactgtatctaaaaaatggagaatttattggttggaacttttaagagccatttactatgtcccaaaataaatatgggggcagcaaatttactgtaacccatacgtggggtaaatgaagtgagtagttcaaagttgaaacttgaaaacctttgatctttaaacataatgtccttcgcacgtgttttccacacgcgtggagtagtttgcagaaactcggaagcgaaagatggttattgggccttggaccattataatcacaaatctggcccacttttatcttttattcgaagcacgtttgcaggacattaatttgatcgtgcttttcactcgtgaggaagagttggtttagaatccggagagaaacgtagttattgggctccggcccaagtttaatttcaaaactcacttctcataaacccaaattttgggcatatgatttgagttggacaggatgtgattctttttttttttgtttctctaacaatataatgtcttgggttattttgtggtgaatatgttgtagggttcaaaacattatagtccacatgaaatcatatttttgggccttgatattttcatatcaatcaatcgaattaataacacattaattgcatcgaaaatgtggtttttgtttgttataccaaaatacgaaggcaaaactcttccacgcaaaaaactcttccacgcatgcctctaacttcatccagttctgttcgttatgataaaaaaaaaaaatataacaaaatctataagatttctaatttgatcagaactttataaaagtctaataacttttgtcacattataagcttttaggaaaaaataaaacgaccgaccttatttaattgcattgtcctaacttcccaaacgttttaatgagattttgcgtaatagagaaacaagccacgagttcgattcacagccacaataatctttctctaccaaataaagacttgatctttctcttctccttctatatccacgcgtcaattcgtaaaaccaacggcttgaaccaccggcaatagccgcgggattgcggcggaggattaatcaaaaaacgcaccacctgaaatctctctgtgtacgcta

SEQ ID NO: 4270 - DNA, 2000 bp, Arabidopsis thaliana
ttgaagtgcaaatgaattaaaaaatggttttgttatacaatgtgaacaaaaaatattttaacaatatatggtacatgtaaaatttttagattattacactactgaatttacaaatctttcattttgtgtgatttgatataaaaaatgtcaaacgacaagaaaggttaagaaaattcttcggaaacattttaaaaagtaaatctcaaaatcaataacatccgaaaaatacacaaacataaaaaaaaaggttcaaaacctataattgtagattatgtaaataattataggtttaaaataaaatgacttccaccttccacacaaaatgtttgtgtacagaaattaatgtgttttgacacacaagttcataatctatagaatggatcatcttttgtcatccatgcacacgtgtacgaattgtaaataagacatctttagtaatctatgtgaagtaggccttttatgtattatcatatatcatcttatattgttttcaattgttttttcttttttgaagaaaatgtaaaatttattcggaaaaaatgtgtttactcaacggaaatttgatcgattttaagttacataaactgaaaaagtaaaagagaaaccagcctccttcaattgtttcgtgaagggcacaaagagaatcagcagctccactatcacatattctgaataatgttcatttctttgaaacattaaagtatggagattgaacatcatggttagaaatgtttatctctttgttaacattattgtatggaagtagaacatcgcagttggagtttctttgagaactgtaaatgtatggagattgaaaattacggcttgacatcttttacattccaaacggcttaactttttttttgcttttttctagagtatatataatcttacaacatttaacaaacacattgaacatttaattagaaaacaaccaaaggttaataacaaaaatttgaaatgtttcaaacaacttctacatatttttggataatcgaacgcagaagatacaaggaagttgctttaaaagtatacagatgaagtatatctatatgtcagaatgtcttctttccgacgatatgcctaggttatagagcaattagattgaaactttgtcatatctagattaataatgcgactttatatattaaaaaatactaccaagaggataagttcaagaagagtttcatcataatctgaagaacctaacaaaaatccaaatattcaccttctgttgtttgccagatcaatgtccaaggaccacacatggttttaatcttgtcattttcctgcaaatttcaatactaactataagaaaataatgataattcaataataagataataatgagagtatgtgactaaaaagaataaagattatgtagataaatcactcgcgataaaaaaaaaagattcataattttattaaaaattatagctgaacttactggatgttttttcttaagaaaactggacaatatatattccaagtgttatatgttttatcttatagaaaagagtcgtgggaaactaaaggtgcaaaacttcttatttacctttttaacaaaaaaaaaaacttcttatttaccataatatacaaaatggacaatatatattccaaattttgcttttgtcaatttgccaccacagagttatctagcacttgaatttaatcatataaattgttggaagaatcttctcgaacccagtctagaatcagcactaacatgctctgtttacacaggacattcatatatcaaataacctctttttatcagtaatcaaaaataattataaaccaaaaattcagaatttcaccgatgtttttcttaaataatcacatatatgaggtcataaacattctcggcatgtccttcaaactactataaaagcaacttcgaaccctccatctttctccaacatcccaattcacacataccaaagaaaacagtactgtttgtttttgaaacctctcctctataaccaaaagtgagattaaca

SEQ ID NO: 4271 - DNA, 1917 bp, Arabidopsis thaliana
tttccttctttttttcttgcatcctctacttgaggttatttttcagttttctgaatcttctggacatatgtgcagagtcttttgccttctggtccaccagtttttcgaacgtcgtggttgagttgctgcggtttgtttgatgtaatggcaggatctgaaagataaatacgggttagtaattcttttataaataagttcagtaaaactttttcacttgactctgagcatcctaacattctagtaagctaagtaagagggttcatgggcttgagcaagaatttcggatagtggatgggctcctaggtatagtactgcttagctcaagagtttcaatcagtttctctatcctcattcaaacccttctcagaagtaatttcctactatatcttggtcatgtttgttcttgctttcaagtgtttgaaattggtttgaaccaatgataaattccaagtcatataataacatcacctatttggctaccgttgaaacctagcactgtaggattctagtctctgaaactttgattcctttactcgaaagctacctccatgttgtttacatgggtaatcagttaacttttacccaccgttcaaaggatcagagttttctagtattctctccactcttctcgaaggacctagttctgatctttcttgatattatgattcataaagtgtagttcatgaatatttggatatgtatcattttgtctcatcagtgtctatgtgtgatgtgaagaacaggaggaggataaaattgcaaacagtgaacagcagaagctcaaagaacagccgacaatacatgattcatggtctgtagattcttctctgtacaattctcaaccatttatatctgttagaacaataatgtgagtgttattaagcaaacatacggaaaaaaacataaacttgtcacgttttggaaatgtatattcgagatctgaacacagttatgtttttcgtttatacatcatatttgtctctctatcaatttggggggagatcgaacagtccaacgctgtgcttatgttcgacagctcttataagttgttaagctgtatcaccttatgatcaatttgctttcaaaattctgtttttttgttcagaaatttcatttcgtaaagtgaacataataatcaaaccgtgaggttttctatcagatttcgcatctgttttgttcttcagtcagactcgagtcttgagagatctgtgtcggtgattaacgcggcataggagaataaacaaaacacgaaaataaatgttttttaatatttaaaaagcgtaacttttgacgttttaaggccgtaacccacttagcttgcttcactggaatcaacccgctaagctcgttctctactagatcccatccgaaaaatcctacttgcttcccaaagttgcaatctttgaggatctttgacataaccataaatatcctctggtaaatcttttgcctcaatattttttattcttccagcaagcctctttcgatctcattgcttaattctgggtattgcttttgatgtattactagtttgtgattttgttttggtggaacaaagttatttgattggatccatttttaacatttttaacattttgaactcttcttcgagtagtaagatccgagtgtttttgtatatgcttcagaggtaactcttgtttagtttggtccatatctagatctgtaactacgtgttggttcttgctctgctcaagtttagaaaattgtgtatataagctaacgaatttaatctcttgtgttgaccaaacaaaaaaatctcttgtgcctgaaaaatttgactgatttgtttttagtttatacttaacatttctactggttgtattgcgccagtttcatgtcttctttgtgattggtattttaggtggatgtgagtaaggttgcattgattccaaggac

SEQ ID NO: 4272 - DNA, 2000 bp, Arabidopsis thaliana
actaaatttatctaaacaaagatgctagagcttttgtttgcgtcatctcatcctaatcctcatatcttttaatcctatcctttttgtcccatgccctatatagtaagtatataaaattggcttggtgatgtatatgaacatatgatgaatcatgtgccatttgaaatatagtataatacatgtacacttgtgtaaaatagcttttggggtcttttaatttgttagaatagcatttttagattgtccattaacaaggtagtttcttgaaaaattttaaaagatattcatgcgccacttaattataacggtttaatgaacaattatttgtggcaatagcgaaacaaaatcatgaaattaacaagaataaacagctaatcatgaacttgttttttctcctctttcccactttgtgctggaacgttccttcgcatcttgtagtaatctcacaaaacccattttcaagaaacttgtgtccagtctgaattgagcgtgtggagttttttggacaaatgtagtaaacaaagatttaatcacccaattagggaataataatgacaccattagataagaacatgcgtaattagtgacatctaattattgtttaatcagaaatccgccgtggcgcgtgggtgtatgccctccacaatccttatccctaatgactttttatgtgaaaatgacacgtcattcagaagcaaaaaaattggaccccccaagccttgtagcatgccacgtttcttccaaaattaagaccaagaatggtcttcacactagtttttatgttatacaagttctttagtacttctcctttggattctttttaattactagtttgttttatgaaaaacgtatgttattgattattgagatatcagtattattatatatgcagtataaagttattgatgtgtatattttgtcatgcaaactatatcgtggagaaaataatgttgcttatgacttttgatagttgggcttacatttggataatggatagggtagacaaagataggaggaaagcaataatagcgaaatgaagaacgaatatttggggaaataggacaaatgaatatacttctctttgaaatggagattcacctaaattattaatactaaagccatgcaatgcatccaaacaaatcagtggtcaagcacactcaattatatgtccacgaagacctttagaatcttcacaaccaaaagctattttctacgctacctgataattctgactcaattcttcttcataaaacgtataatgaagctttatgaatgattaattatagacacaaccggccctatctgcgatttctacaaacaatagaacacaaaactttaaaagttactacaaaataccgaattgactatatatatcatattatcagtataaacatgattagattgatcatgtttatcagtaatcatgaaagacaaagagtgtgactattgtaaaccaaattttagaataaaataaataatttatcatactatatacagtattttgttaagtatatgtcatccaatagtaacattatcatttaaactgaaaaatgtttcagctactttaaggaattatagctttattaaaagtatatacttttaggtcacgtgtttagaggtgaagaacaataataattactcaataagttcaccagtcacactccaacatcttattcaaattccttttaaaagctttttaaccgtggctgtttgatgaccatttgacaaaatttagtatattagaaaaaaacaataggatagggataatataggacattagactattagatggacaaaatgaagtattatttaattttccaatgtaccaaccaataagaaagaagtgacgcacagtaaacgacaaaaagctcaagcataaaaacccaaaccttctctgctttctaaacatttcaagaaccttgagaacatcaaaaactaacacagaaagaaaaaaaacagttcctgttctattagattgttttctaaattgtctgaaaatc

SEQ ID NO: 4273 - DNA, 2000 bp, Arabidopsis thaliana
catgctctacgtgattttacttgcagttcacgccggaaactctcacgcgtcgaccacgtgactagacctagttcataatttttatcgtctgaatgtcaaaaactcaaatcctcctttttataaccgttttctttgaaaacaaggtattttcttaatcttgtttcatgtcttaagactaaagatattaaaatctgattttggctctacttatactaatgtcgtattacaataactaaagtctcaaacaatattctttaagcacgcattgctggaaaaattaattacaggggggacataagatctcaataatatagactgaagatatcaacttttggctatttggagtcgttacatctacactttcaaacaaaaccaacgaacccattgttttttgggatcctacgaatcccttgtgtaaacaataattaaagacagtcctaaactaatattctcttatcaagtttggaaacattgtagctttgtgaatatattattttgtctaagaagaactttttgtttgtaaatagtttttttttttggatgtgtttctcatgaaatgcaggtaagaaacatctaatgaattagaaatagattatgaataaaagaaaataatttgtaaaagaaacaccgaacaaggagttcgtattcgtatactaattggcccgccaactaccaacaccgacatatgtgctttcggcagttttgatatcattccaaaatttcaattattatttatcaaatttattttcttggtaaaagtttaattaatttcaattatttgaatgtcttaattcactgattacaaattatatatgtaatatatacataacaatttcgttcgtggagtgttattatactccttaagcgaatctgtatattttaaataaaattttgatttatgcacacgtacatgttcaattgaaacgttttccctaactatagatgccaataaataataagttgatttttaaaatgtacaaaacaaaaggtaccgttttgtaaaattttgcaaccaaaaagtacaatcggccgttgaaaatcgtggaaccaaacactaattaaagagaagtgtgaatataatctagtgtttgcggatttatattataaaatttgtgtatcactaaaatgtcaaagcatgctttgactggtcaataagtcaaattaactaacaaaccatgcgaggcgtaggtttgacttcttaacataaatgctgactcagtttttccattccgcagctgtcgactaattggacacgcttcttccaatccctttccactaatcatccatcaacacgtgacatgcctacagtgcacgacttcacagtgatcatgtcaaagttttgtttttaagagaagaagattcacgacttcacagtgatcatagtccagttacaaatttgaatgggcttatggcctgtggcccatttaagtttgaccttaatatccatcagaaacccataccaatacgggtcataagtgcattgtccatatagtgtaccgcaatgcatgggagtactactacattccaccgacgtgcatatggggggacatggtcggtccattaatcccttgcgcatcttattccttacgcgaatacttttccctcttttagttttgtataatactttccatttttttggtattaaatttatcgtgtgactatctaaaaaggtatttaattatctagtttagctataactgcaaacaaaatatctattttcatgaatgatatatttttgaaataaaatattgttgtcatgtaacgaaaaaatcaaaaatcaagcagaagacacgtataacccacgctttcactctcactcgtggaaaaccctcacacgtacacaaaccattataaaatttaatccatttacatcgaccgacttcataagaacatcgtaatcccatccgtttatatatatattccaagttaaacttcatatcatacacacaaacctaaaacaccgaaacaaaaacaaagagatttaaacaagaagagttatt

SEQ ID NO: 4274 - DNA, 570 bp, Arabidopsis thaliana
gacttgaagtatgtatctttcagacgtgtctgatcatcaattgttttgttgctgtttatttttattggcagttcattggatttcttgagccttacatggaggatggtcactccatggcctggaagcattaagaccgcacctgtaaacatctctgtgtctttaggactttgtgaactttctcttgtagttgaatcgttttttctttcaacaagtgtaaatttgtaacgcttcttttcttgtgacaaaaaaaatcaaattttttttttttctaagaaggattttgtggttgatcttgttatgattagggtatgaaaagaaaatatgaggaccaaagtgttaagacaaactgtaaattgggcaaaactgtgaagggacattaaagcgatatatgattgggccttaaagcccattgtttgataaatcgtccagagggtaaatatggaatttcaggtttacgaattagggcttcttgatacaaagtttttaagagatctctttatatcctcgcgacggcgaattcgctcgactctctctgtggacggcggctagtttcaaccaacagattcgaga

SEQ ID NO: 4275 - DNA, 2000 bp, Arabidopsis thaliana
tttgaatggctacttaagtgtggtatcttccgttccaccttatataactgtcttgcttcgtgctccattcatttcatagtgtacttattccataaagatgactttacacttaattcttatcatagttaataagcacttaattctttttctaatgtgtcatgaacacatgtgcacggtaattcgataaagccagtatgctaaagtgtaaaggcacttgtctattcttaagcaataaatcactgaaaacaatatttatcggacaaaaaatcagatgtaatagatcatttatgtttaaatcagtcaaattcaagcatattaaagggtgaagttttatgaagaaaaaattcaactaaaaaaacaaaatgacacttacacagttacactgacataactaaccaaatctaaaatttataaatttgtcacatcgtttaatcgttatctgtagctttattgccttttatctatgtcatctacatagatggagtagtaagctgagaagagaaggagaaatttaaggtcaaagttacccatcttccgacatgcacgtggacggccgaaagttcacgagaatcttagattattccacagtgacacatgtcggcctttgcgtgaggaagttttttggtctctaatttttttttttttgaaatataaaaggagataaaaataaatacgtaattaattatacattttaatattaccgttaaattattcgttataatctcctatattgaaatttgaaaacaaaactttattaactataagcatgataaatatataaccgtttatgataattctgatagtatacgtagtttttttttttttttttggtgagattgtttatgaaattagcaaggtttgacctatcatcaaaccttttacctcatgcaactaattaatgggtgatttcttttttcaaaattgtttttaataataataactaattagtaattagtgggtattttaaataccattatgccatttagctaaggtaaaaaatcaattgttaattataacacccaccaccaacatagattcgtctatggttcattcatcgtgtttaagagttgaaagaaataaattcgcccatcgtgaataatagatatttattcatctcaaacttataactcaaatatatttcaactatatatcgatcaaatagtatagcttttggttaatgacgaatttttattcttttgatccataattcttcttcttcttttttttctgtccggatacatgaaattgatgatacacatttaaaacaacaattcgaatcagggaacaaattacagccacaaccagtgatgatagaccatatatatgatttagtttatttaataaataatgtgtaagcaaatttggctttgctgtaaaaaaagaacacgaattttggcaaaagtttctgttaggaatctggttctattctcctctgcaacctccagtctctcatgaatctggttcggattctctttttccttgtttctatataatttagatacatggttttataattctatcatatgtctattttggatatagtattttaaaaatatatatatttttcataaatggttatggtctattctatgttaatgataatcattagtctttttgtcaactatgtttttttttccaacaaatttagtatgtaaacttttttttactaccgttttattaaatcgacggttgatcagatcaactccggtataacacaacataagtttcgttatcaaaacaaaaacaaaaacagatttttttttgtcaactaccagtgaagattagtcttacgtgtcaagaaaccggataaaaatatataacgtatttgggcaatcagctaagatattaactaacgcggagttcattattaaaatggagtaatgatgttttcagttttctatataaatcacgtcgagaccgtagagtcttacacaacaatccttcttacatttctaccaacaaaacacaaaacacaaacatagcattcaaaactttgaaaa

SEQ ID NO: 4276 - DNA, 1765 bp, Arabidopsis thaliana
gcttttccgttgaagcatgaatctatatctatctcagctttatatatatctatgttcacaaacattcaacaggaagagaagaaaaacgagaatcaggtgagattaaacgttaccgaagctaggaggaagctcaaaggtttgattctggtgatcgattggtgctcttccacgaggatttgaatcttgtttcacgttatcttcaacactaaccagagttcacatcttttgtgttaatgacgttcatatttttgtgtgaatcttgtttactttttagtttttcgaagagttaaaatgtttttaaatattaaatagataatattttattaattagtaggagacatttggtcatccatatttggtattcctatgctcaaatcacatatggacattgatatgtgatacacaaatgtttcccaaataatcgtctcttattaacgttgtatttattggtaaataactaaatacaagacctttgatgttcttagaaaaataatctgcttactacaaaaataaaactgcaagagttcaattaattaaagtcctctttgggaaagtttgttataagtgctttaaactgaataaaagaatccgaacttcgaagaaagaagaaagaagataaaccttaacccattaaataaaggtcagtgacatcatagtccatattcgaccactcatcatcatacaagacagataattaatcgtaaataattccatgttgtagagtactttttattattatacaaatacattaatacatctttcacaggctgttcgaaactgtgagtctgtgattagtgattagccttaattaatttactttattgctttgttagaaaaaaaattacacctttctttaaattaaaacaagttgggcaggaaatttaaaaacccgttgggccattaggattcacaaaagcccaacacctacaaaaagagatgtctccatctcatagtccatataccacatgcttaaaccagtttaaattgcatataccacgcgccacataaccggaaagttttgtacacgcgcgagacacagacattatcctttttgtatctgtcttccagcgtgtcgagtcagtgaggctccacgtcaccctttgatccacttaaattttaaaactaaaataattgtttaaatgaattcgagtgattgatattttattatagatttaatacacacccgacactctgtcaattctataggcatacgagctcactccaaatttagattcagttttttaatacgaactttttagttaagccaagattagcaataatatagatcatttattttcttgattgtagtttgattgttgtttttctcataataaaaaaatcccagctaaaatctgattttcaattttaaaccaatttatatggtaaacaaaattttagttcggtataattggaagaattaagttttgttgaatatcaggaaaaaagaaggggaggacaaattttctacagaggtgacgtggcatcattgaaccactttacttgtcggcagtgaggtgtgtttaatcacgtgtaacgcatccaatgcgtatgagagctttacagccgcacgatcacatgggtacaaaaatcaacggcgaagcaaaacaagagtctcacacttattaaacgcgcgtagtacgctccaccggtataagctaacggaggatataaaaactctttaactcattattgtcctaaaatctcaattttatccattttcacggaaaaaacataaaatctgttcttcttcttcggctgagagaca

SEQ ID NO: 4277 - DNA, 2000 bp, Arabidopsis thaliana
agcagagaagtcaataaccagctggcatgatcaccgttttgcaattatccccataattaccgcaacacccttctatttttttatccttttttttctttaattagtatttactatttattatcgttatgttcttaattatcctattattgttttaaatatttttatatagcgaaataatttatttaagaaaaagtcaagagaaaattaattgactatatatggaaaataatttgagggtgcgaggcatgacctagctagagaaaaataaaataaaatgaaggcatgcatggtgcttggttcaatgtaattagtggttccgtaggtctgaacggtacggactggccatgatctactagaaacagtaaatagttaatacaaagtaattaattatgagtttcagcaaattaactactctatatcgaatgaattaaacagtaatccccagaaaagaaaaaaagagaactatgacagccttttcaaaggacacccgaaaaccaaaatgaagattttaaaaatgccagctctgcaatagatattgaactttcatttgtaattttctttatttttgttgcattacacacatttgttatttacatttaaattggctattgcaataaaagattactttatatgcttataatagtacaatatatatggtggcttaaacaaaagtttggctggcttgataaatacatcttacatcgaatgacgattttaccctctatcttgctgtctctgagtacgagggttgaaatccttacgtggcattttttctcatttttcttggtcaaatagtttaaccaaactccaaaagtctgtgatttgttgacatacttctaactaatttttttttataataaaaatctattgtatctgtagaaataatcattagatttactttctagaatataacttcttatttcttagtaatttgtccagatttttttttacaactaactaaacactagttaaaatgttaatgtctaaaaaataccattacaattattcaatttaataaaaattgagtcggccaatttaatgcgagacttctgtacaacgaccctaaaagtgggtttgataaatgaaacatattgcaacaaaaaaatactagtaataatgataaaatagtaacatgtcgtggcgcattgaatatcctacgaaggtttagtgtttacttttaaaaaatcctaatatgatactagtacatatagctagcttgccttgcttatgctattgcatagtctgtattaataaatgatgttatacatttcgatagagtaacattttgggaacatgagtgaacgtgcttgaatcttcgtgcccttgacgtcagaagctagtaattttaaatactaattaacattcatacaaattaacagatacaatgtactatatcataattcgtttccgtaacacaacgcaacaatttgaaagtagatgtactttagtacttagttagtgtgcaccaaaaaaaaaagatgtagttagttagtaaggggttaaatgttttaatttattaagaaaacttaaattcattaaatgttagaaaaagtctaattagtttatattcgaacactgtgctcaaaattaaaaagtcaactattttagactatagagtttattaattaataataaattcgataaatcaccgtattattttcttcaacgacaagtagccgtgaagacacgggagcgaagagagataaacagaagatgaagaagaagatcaatgtcataatcttcagggagataaatccgtaatctttattaatcaaggttaatccttttttttttcttcatcttaattctttgcgtcttccttttctatttatcacgagatctgtctttctttttcctcttctttctctctcttctctctgaagacagtacttgtttctgtccggcgttaaaagcttcggtggtggtctcttgacttctctgagaagaagaaaaggaagctgagtctcattttagattcagctcacgaggaagtgacgacg

SEQ ID NO: 4278 - DNA, 1278 bp, Arabidopsis thaliana
agagagcgagatcacatatatactgatatacatctcttgctatagcaaagtagctgttataatagtgacttctctgtaatcttttgtttttttgtttcatcaactaaaattaccaaaaataataacaatgttacaaacactcaatcacatcgagaaaagtaaagtaaaattgtgaaaatttgtttagtacttaaaaagttaggaggaggaaaaagtgtacatcttattttgaaaacagacactacgcaaacaaccatggatcagacgacgatgatccacaacagtcaaggcaaacaagagatagatagctcaacagacgatgaagatagagaagatggaacgagacatgcagacaaaagaggacttgaaaaccgtggcgttgggcacctctaagatcaactacatggatcctaggatcacggtcgcatggtgcaaacgtcatgaagcacccattgaaaaggtagttaattatatacaaaacttgaatattgatctaccatgaaacaaagagagtcctctaataaagttttttttttgtaatggctggttcgttaatgtagatattcaacaagtcacttctggagaaatttgcgtgggcaatggacgtagaacctcacttcacattctaatatgcattgcactgcagcagctgatgagagtttctctataaaacagagcaaagcaggctacattttttttcttccaagtagataaattctttttgtttgtatctttatttgagatcatgtcttctttttttttcgtatatacaattgttcattgtttgcttgaattcaaatttagtctgttttataaaaaatgaaaccataatctttactattttaaaccataaaaaaaaagtcaattgtaaatacaaaacaccaaaggccaattaagatttattccaactggaaggatagagcaaaaaaaaaagaataatctggcgcaaaaatgacttacacaaatcaataagttttccaaattttgtttctttagcagaaaatcaaaaatgttattttggtcacaaatgtaaaaattggtataaacaaggttttaacaaaaaaagaaaaatatatatatacaaaggcaaaattacccctgagaaaatctggggccttgacacgacgatcctccatcatcctcttcctcgaggaacttcaattccaatctgtgagatctctgcacaacatcttgtctattttcaatcgaaacctctgtgagatcgcttttgatttttgtaattctcgtcgcaggatatctctctcattgggatcagac

SEQ ID NO: 4279 - DNA, 2000 bp, Arabidopsis thaliana
ccgacaaaaccaagaaatgttttttgcccaaatctatttttgcccaaatcgacttaaacctaatatttttgaccattgggccgcccatgtccattacgtccagtccgctaatgtccatgtccgttaacgcccatatccattaatgtccacttcataatgggcttgtccatgcccggtccattaagcgttggacacgggcagcccacgggccgcccgtccattttgacagctatacatcgagcttttggattggagaccttaatcattatatttgaattcatatatatttttcgctaacctgttaaactaatcacatttggtgtccacacttatattttgaccctatgttactatatatatatatatatatatatatatgcatgtgcaattccattgtaaataaccaaatcgatataataaggaatgaacctcggtatgagcttgagtcttgatgttaggaagtgacgatagtctatagtgacctgttttgttatgcggttagaagagattgtggttcaaaatggtcagaatcttttggtaagattaattaagaagttgtagcattttcataaataataaagggtttatttgtataccataatactattttaagcatcaagtacatttatgtcacatctatttccggttagtttaattttattaatttcgtctgtaaaactattcataactaccaaaccccattttcttatttttttctcaaaagaactaccaacagatcttcaacggtcttgttgtcgaattatttatttactttctcggggcctttgttactttataattagaaaaaggcgatggtcaacattctccggttaacccccataatgcaaaatcttattttgggcaaatgagagggtaaaatagtcatttaaagaattccgaccggagtttctcctttgattcctcgcccctatactacgcgtcgtgtcagactcgtaactccgtttgactcaattaccccacatttttcattccatcatttcctttttcattgttttcattgtttttggctagttaacatagccaaactatgttcattatgcaactcacgaaacttaatacaaagatgaatctaataactctggttaacgaagtatattctccgttgacaaaaaaaaaaaaaaacacaaacagagaaaagtgaaatctgttgtattaagaactttgtagctcctacaagccttttcatatattgaaaattcacatatttagcaaaagaaaaaaaagaaaattgaaaaatcattcccgttttcatgtactaaaaagttttaacagtaaatatgcatatatttaggaaatgtatagttgccttgataaattggtaagtttgatttaatatgcatttaaatataaaactctttttacatatacttaatcttcaactatcattctaaagtcatacccttttaacactttatttatcctctcttttttttttttggacaactaactttattttatccaatcagcttttaaaatcttaattaacatggtttggattggacaagctaagtaataatactataatacgccacgtatatatacgacgtatccttcttctcttcacgtataaaataaaaatagtgtgttattgccataacatacgtgttttctaaaatttaaaagaaagtcatttatcatgaaaaggtatcataatcagaataagagtaatcagtttgaaaactagctagttgactaaaacagaaagaaaaatatctttacttgaaacatgtgttgagaattcacattatataaaaggaaaaaaaataaaacatgacttttgcgtagacaatccatagtccaatcaacaaaacgtgtggacggcaagggttccttctagctctctctatttatatctctcactcgccgatttttactagtaattaaccagaacgttcatctaccaacaaatcctcaactccttcttcttcactaatagtataccacaaaacctcaaaattgtaatttattagattatcgtg

SEQ ID NO: 4280 - DNA, 1492 bp, Arabidopsis thaliana
cgattcgggtcaaatttgggagttataatttcccttttctaattaactgttgggattttcaaataaacgatctttgatcaagaattgcattatatatatataaatatattgcaaaattattagacgagccaaacttatattcaaataatgttttatctattttaaaaaatattctttatgcgaaagatcaaactccccaaacgatgttaaatggatcacgatacataagtcgatccgaattgttgaagttttctaaaaatgcagtccttataattgtattaaacacactaaatcttccaaacacacagaaggaaatcactataattgttataatggatataggagaactaactaaaaaaaaaaacgcaaagaaaactttatacagtacatactcttatggtcttaccaattaccaacgatgtgttggttacacaaggtaaaatatatcgatcgtagtactggattcatattattcataatatgatgggaaaatgaagaataaaagtacattttgtaagtagaattcaaccatgaactgtttggattggcaaacattttttatttgtttttggcaaacataaactcaaataaaatatctaggtataattgtggttcatacaagaattacttcatactgttgggccaaagggtacgtatccttccccgcacctccaaaccatgggcttactactgatcggacatcaaaaccttgttagttgcaaccaacgaataataagtcaatacgattcaacttgtcaacaaatatacaacttatatgacatgtctggctccaaactggatttgagtagaaagttactaattcacaaaaactaatttatatacacattttcaatttttattttataaatcaaagaaaaaaaacatgaaaatacgggaggttcggcaaacacaacatttaacttgccaaacgtagcatctaactatcccaccttctacaaggcaccatttttttttcaataataaagttttttttctttaatttcttcgccaagaagagcacgaaatgtttgccaaacgcatatgcaacaaccccacgttacatatttctatttgtagctatagagcaagctatattgttaaaaactaaaaagaaaatctttactataacatatagatagaggattcgagatatcttgaaagactcaacttaataaataaagtcgaaaagaaaacacggaggcgagaggaccacacactcgcacagaaagagtctcatatcctctataacaaattgataaactaaactaaaacgacacgtgatgtcttgatcagccaataaaaagctaccgacataaggcaaaaatgatcgtaccattaaacgtaatccacgtggtttcagattacacgtggcaccacacaagtatctccatttggcctataaatataaacccttaagcccacatatcttctcaatccatcacaaacaaaacacacatcaaaaacgattttacaagaaaaaaatatctgaaaa

SEQ ID NO: 4281 - DNA, 2000 bp, Arabidopsis thaliana
aattaaaatcaataaaatcacatgggaatactttttgccagtattttttgatcatttgttaataaactatataccaagttgtgatcttttgtgtgtgttggttttatcaatttcctaagaattataaatatgcactatatcttgtcagagcttatcttcgacaacaattttaggtttccaactgctcgattttacattcttgtgctttgcaatgggttgatttatcttattgcatcgggaatcagaaaggatccaacatgtaccacaaccacatgagatcttcacgtcagtccctcgtagtttacatacgtgcaataacttttttactaagaacttaaaatccaaaatataatatgttcgtatagcggatgttggaagacatatatattaattcatacacaaggtttttagacccttttaactttctatccttttttttttttttattacaattctacacatatagtttgatataaggacgaagacttttttttgataaaggatgtaaacttataactaaaggtgagcacaaacttgtgttttcatatatgtcgtcctgtttttaatttcaaacctcatcccatataaaattaatatccaacaaaaaatttgtatcacaaaaagcaaatttttgctaacaaaagaagagtttttgaattatcaaagaaaaaaagatttttgtatcaaaataaattcgtcttggatcacaacggtccggttcaccagtccaaataacttcaccattgtagaggatacttgatcccaaaagaagtgatatatattttaatttggtagacctttttttttgctaagatatttgaccccaaaaaaatgtatatcaccccaaaagacgtttctgtagacttataattattattagaccgcaatcattttttcttggtatatcaaatcctccagacatacatttatcagtgatcttacaatcacatttttttttgttaaatggtttttccttgtttaatagttaatcaatgatcatactagcttcccttaatcatactagctataaaattaaagatgaaaaaaggttgtgcctttaaaatcaaatcctccagacctatgctataaaatatccgatacattttaaaatataatgtcatagtcatggactcatagttcaaccttcactagtattaaaagtcagtaatattattttgaaagaatacaaatagcaatagtataatgatagtagcattaattattgattgaatgaatcaattattattttagctgaacaatttttgtgaacaccgtatctcctagaatcgataaaaacttttacccaaaatctcaatgttccttgatctcgcaagaaacaaactaaaacggacaagagcatcagaacagtgtcatcactcatcagtatatgcatttccgtgtgaccgcgaactctgacagatgctcaactgatccaatgacaacactgcacgtggcatttccccacagtgacttagtggcctgtgtatagaaagatttaaagaacgtgtaatcccaaccattcctccatcaaagatatatcgatcatttctttttgacagcaataatttttaatcattttatctgtctctctgttctttctctctcccgcagtccctctcgtaattttgctatataagagcacctctataatctgtgtgagacagaattataaaaaaaaaacattgatagttttgtatctaaactcaatatataatgataacacgttcacgtgttcatcgtcaaaagagtgtctcagtgagtacaatcttcaggtgtcttctagttttgatcagacgctctattcaattctcttaattagtcatatctttctttcttttttcctcgtttcgtgttaattttattttaaaacaaaggattaaagagtcgttctttcttttggtaacatggagccttaatgatcctttgttagctctagctaggattttacgtactacttagggtattcaaactaaaataaaatcaagaagaagagcagagag

SEQ ID NO: 4282 - DNA, 2000 bp, Arabidopsis thaliana
gatctgttaggtttttttgtgtagaacgtttggacatttgctggtcgtgtctgaaattttgagtgtactacggtcccatagtttttactcttcacattaagatgatttttacgtataatttggtgtctcatttattttttacttttttgctagcaaaatattttttattttttttcacaaactcacataaatatgtagggtggaactttattgctgtacagttgtccgttgtttccccaacacatatatatatgtgtaaatgaccattaattttcacattgatttcttcaagtttctaatctttaaatctttcgtagactttgcactcggacagtctgtaaacttcaagatgatatcatgctttcgattttaattatctcaaaataagcatacaccacgacaagatccactagctaagggggcaatataaaactcaatagttgacaaaatgcgagtaaaaacagatatggagagcactaagtttagtttaagcgcatacaatacgttacatacagtcatattcaaaatctctcaaacaatctcatttgaaataaaaggaagaaacttggttgagccaaactgtggtaaaaagaaggctgatataattcgatggttggtttgaatcacaatattgaatattaaaaagaaatatatccatgttagcacacgttcatagcgaaagtgattctcgaatatttgttaaaatgaggataaagaagaaaagaaccatcatcaagatagacaaatgaatttttagtttgtagataaaatacatcagaaagagaggagcttccagatgcaaacaataatgcagttggatttcggttatatagaaattgcatctcactcactctacatattgaattttgatgacctcagactctttaagtaagaaaagcatcatagtttcatttattgtttctattctatgtattggtaagcaatgccacacaacaaacatggaaacaaaaatccataagagataaaccaaaatgacaaaataccctaaataccagattaaatcaaaacgttagaacacatttattggtagttgcttaggttaattattagaaaattttggctttttaatcatatatttgttaaaagagtcttttacataagagataaaatgaaatgttcttagctttcatttcaaaattttcaaaatcaattataaaaaaatcctaagaactaagctaagactaacctaagatactaccaataatgatgttcttagtcccaattttcgacgaatagagagaatactgtttcgaaagaatctcaggttcctcttacttgacccaatttgtcattaaagttttaaaatttctttcgttaattaatacagtatttattaaataaatctcgttcaaggggtgttttggcaaaatagtcactttttcaaacttaattaggaaagtagtcactttactattcataatttgcaaagtagtcacttttcactgtttgattcgtacacttggattgtacatcacttttattgtacaaatgtaaagtgtacgctgtgtattttttatatacatctgatcactaaaagtggtgtacaaactaagtgtacgaatcaaacagtgaaaagtgactattttgcaaattataaatagtaaagtgactattttttcaattaaattttaaaaagtgactagtatacaacttaacccttaaaagttactactaattggaagataggaggagcgccatcaaaagtcaaaaatgatcattcaatcaatgataatgattattattatatttgatttctccagaaaatatgtgaaagttgcacatgccaacctaaaccctcaataatacatatatttgatcttagtttacagttagatcgattgttgactttccgctggcacaggctggaaatttgaaattgtctcgttatccgcaagctacaaagtgtctcgaggaggactcagttcttttttaatttacaaatctctctctttctttctctctctctctctctagcctcc

SEQ ID NO: 4283 - DNA, 1750 bp, Arabidopsis thaliana
cttcctcgccatttgcaagcgttaatttctctgaaagtgaaaatacatgatttcaattgtaatgagtttagtacacatttgagcgatactatacaaaacaacaactattgagattctaaattacgaaaccgaagcgaaactcagaggaatccgaattgatattaatctagccggagagataaatgatgtcgtaatgattctacttaccagaagaaggatttgttcttctcggttgagattgaaagatgaagaacaaaaccctagaaatcaccgacgaggaagacgaagtgagaaatggttgtggaaattggaagatgaagaagaactcaagaagatggtaacgagcacacgcatttgtctctcaaactcttctcaagcgttacgttataatgggcttagattttatcatataattgggctttaacgtttcgtttaggcccattttaaatgttttttttcttcatatatgtccctattttaaatgttttttttcttcatatatgtcagttttggatcagttttggtgtccatttaatttcagcaaaataaacttgtgcaagacatttcttttaccaaaataaaagttggaattttatatcattttaatttttgacagagattactagaaactgattaaagtacgctacagaaaaataaaaacaacattgctactcaaaatattttgaatcaattttgagcgaatatggctaagttgcgataagaaacactgattccgaaatcacaaagcccgagaatttgcgtggttaccacaatattgaagcactacaatcatcatcgttgttgccacgagcatatctattcgaaatcagtcctcaacacctcgtcatagaaaccatatcatataagacgtggtcatcgtttttgcatgttgccaagacatgcaaacttgtttcctttttccgaacaagaaaacatattatataaaacgtacaaaaattaatttgatcgtatataagttttttgcgggttgtacattatatatttatatttactcataattagtagaaaagagtacatttggttgccaacgaaaacatacttttttctcttttctactaataataatgaaagtacaacttttctctgcttgacttgtccacaatggccaatgggtagtgttgtactaaataatattgtgaagactttgttagaatgataaacggcataatgtatagagatggattcaaaactcgaatatttcaattgttttctattgaaagtgtagactagcctttgcaatatataatatacacatctacaaagactgcaggttacagcgacacataacattgattaatgacttggtaaacgtactaacatctaattcaaattgagacattttaacaatcatgtggttttaatattaaaatggatactaagaaaagatatatagattgaaacttcgattaatatatcattgatcatttctttccacattatcggtaatatctctctactcatatgctctattgatattgcatcattcgagcgacaaatttacaagtggctcaatttcttgtgaaataatgttttatactaatatttaatgtacaaaataagataacctttcacaaaaataacgaccatgtcgtattgtccagctaacaatttatttttaaactaaattcctatacgattaattggtcataagtcattacacttgcttctgtttctgtatatataaacttcctttttgtatttctttcggacacaacaaagaaagaggaag

SEQ ID NO: 4284 - DNA, 2000 bp, Arabidopsis thaliana
atgtaaactgtttttaatcctgttagccttttttgccttccatacaccttgcagattttaggatttctaattttgtttttgttagaaattggaatggttttgaaaaaaggtctaaatttttgtgttcacatgggttatagtttatatacgttgttggttttaatttgaagtgtgatcagccagctctatgctctatttttgagagtaggaaacaaagctgtaaatttcacgacatgtgaaaacaaatcaaacgagtttccaaaaatagagaaatatatatacataaagttgtagtcgtttgtataggtcaggtcaatgtacaagtgtaatcggctgttaatctcatatatgatatctaagtccaacttggtgtatagtggattttgtaagcttgtaacaataatttaaccaaaagacggttaattcaattaagatatatatcaaaatttgaatttatctgcactgaactataaacttctaggctgatttaatcaaataaatttatatatagatacggttttaaatattgttgggaggtttatatgataaaaatcaaactgaatgtaattgtgtcaaacttactatactattgatacatagtacgatgaagtactatggatattcaagtttagcttatcaatggtttacccaaaaaaatatggttacttcagtcttgcattgcatgcatagtattttgtcataggtatgtatattaatagtctggacataaatagatatgatattcccatgagttcgttgctcaatctggtttccggctcgatttgagtctttctattattgttttggtgagttcattttcaggttaatatctgctttgagttggttcggttatgtttttattcattaataaaaattagtaccgaatcacctgattaaaattgtggtttggtattttcaattctgtgtgatactcctaactaaccgtaactacctaagcattcatattgtgactattccaagtctaaagaaattaaatatggtagagttgcttcattttagaatgtggtagagtttcaattttcttaacattgcatcatcctttgcatcaaactaattaattagtgaatatgaattgtatttggtagtttggtactggggacaataaaagacaagtgaatggagacaagagcgatacttattataaaaccaattaacaataatttaatagttgtaagttgtaacgttaattttctaacttcaaattaaataagaatataagaagaagacgtcatgaatataagtaaatatctaaatcaatagtatataattagcaaaaagaagacaaaatataaggccgagagggaataattgatacacacacattatttgtttttttcacgagtgactctctattgcaaatggaacactggtccaaagaggtatagagaaagacataaataaaattccataagcaaagttatgaacagcaagaaacaaaaactatatgcgttcgccaacacatctcattcagatcaacccaactatgaatttaatctagttaaatatattcagcaatatctttagactgcaccgcctatataccgcagtttcatttatgaattaaaataggaaacaaaatttcgtttgatctttaaattttttcacccaaatatataattaaattaactgtttataaaagaagttattttgttatagttttttttttcttttctttttgtttcatctgcaaatggttcagattacaatgaacggcatcaatatttttatctacctattttgattgttcacgagatttaattaattaattgatttggcaccctagttgttttagtcttagttaaaaaaatttgaatacattttgttttttaattttctttataaaagggtatttaatgcaaggtagggtgtgtgtgtaagaacgcagagaagcaggtgaggtcaaactagacacaacacttaatgcattgagcagaagaagaagaagaagaagaattaagaagagaaagaaaacaaaaaac

SEQ ID NO: 4285 - DNA, 2000 bp, Arabidopsis thaliana
aaaacacctcagaatatcagcaaaacgcttatcagctgaccttgatttattagttttttttttatgtttcacgaaatattagttaatcataattccaagaatgcttgaatgtctatataacctaacctaccattatgttcttaccatgatttaaattatcttctcaagttccattttcgtgaagaatatatgaaagtcaaatattatttgctgaaccttttttttttccttgtagcgtgcaggatagggattttggaaactatggtctaaagctagagtctacaatgtcaaggtaaaatattataaatttaacattccatcatgtcatactaaaaaggaaaaacaaaaaagtccagtatgtgtcattttagccacacaaacaacagcaagtgcgtcgaataaccatcaaataaatgatctacacataagaaaagatagaacaaaataaataacggagaatgaaaactgaatattttttgatattttattttcataactgaaagtatttatcttgaaatttttaaaacgactttacaaaagctcaagcaacaataatccgaacagaatttttgtttgtaaaatgctataatcatgcttttctttctattcaactttttatcagttaaaaggcagtagaccaatatattcaagtcttaaataattttagaaacagcgtgtttcatacatttgtatttttggtactttttagctaacatattgacttttatacaaatcttttttatactgaagatatttatttgaatattttatttagttacttattttagagagcgtattgactactgactatttagacaattttgacgttcgcatacggaacatttttgaaacgtaaatagctatcctcaatgtcacttgaagatgtgatagtggttaatttagccgatattaatgtagcatcacataattttgagttgcaagagtctggtgaaccaaatttttgtaaagagattactgtttgaagacatgttaacttacctaaaatttatattctttctacttttaaccctgaaaccgaaatcggacaataaacttcataatttcatagttctggaaaattatttaatagtaagcatttagtttgattgatgtagtaatttgtcattttttaaagtactaaatcttttatttgttttgaaaaagtttttaaattttaaatagtatcacgaggaagcccccgagtgacgactgacgagtcaaagctccttcgaggaagtttcctatagagctctctctctatctcctctcgttcctcctctattttctcgagaaagtgacggaaaataattcagcagccagagagtatcaaagggaaagagctgagaaaatcctctgttccgccgataattgaggtagatgattatattatatttcttttttttcgattcaacagtaactatagaaaatttgttgtttctggaatcgccagagattttttttttctctttttttttcctctttgtttacctttttgcttctgctactttgtgtttgtttattcgaatctctcctgcgctttcgcacgatttacgatgttaccctacacgattgttgttggaccacttcctacacctaaaactaatatttcactgagctagattcttcttcttcttcttcttcttcttcttcgttttgaattttgaaatttccgggaaatttttcggtatctattcgtttcagtgtatctatcggaaaacggattttcgaaggttgtttggttttaggtggcataatttggcgaggagtggtaattactgcttcgtaacagtgaaatgtgagacttgttcataagagatttgtctcgaatcgtatttggatttatttggtagtgacttttgaattggactgagattggttttagagaggaagaagagaatgctcaaggctatgtactgtttctgattgggatgcgttttttgttctcttttgtatgtgtttagcttaaagaagagcgtgttgctatctctcctgcgacagtc

SEQ ID NO: 4286 - DNA, 2000 bp, Arabidopsis thaliana
ccctgatcaatcagagtagccacgtgggcgggtggtagaaatcgaaattattgcgattattgacttggaaaaaaacaaacacacgttgcattttttgatttacgtatccaaaaagaacaaagaaaaaaaggtaaacgaccaaataatataattttctggggctgtcgtcttccatctttatttcttcttggcgatatcaccatatcttatacgtctctcgaaagattattactcttaagacgattccattaaacactgattgtgagaacttgtactttaacgttatcgaaaagtatacataaatatttttatttttttaggctgattcattcttactgataacaataattttgtgttattctttcttacctagagagttctatagacaagttcgtaactataaaaccaatctttatttcttactcatagctttcaaaactaaaacttgatcagtttaaataaaatatatgggaaatttttgctgaaccaatatattacgtgtcaagatttcattgatcctattaatacaatttattcattttacagttatatcaaatacaaattacaactaagatactcacttatctacacgtcagattgtacaactaagatactcacttatctatatctaattttcgtggttaatattacatgtcaaaattttatggaaataattagtgtttttctactttatataaatttttatgatatattttttttttaaaaaaaggaaagagaaagaaatcaatttccatttgtaaacatatttttggttctgaaaataaataaatgggaaaaaaaggaattaaataacatctgttgttgttagctgatcgacaggtgttgcctgaagcgaccttaaaaaaagaaaaaggacaaaaagttgaagaaaaaaagaggacaaagttcacaaaatgatacaaagactaatacgtgtccttttattaatcctcttttgtaataaatactcttttttcctataaattatattacaaaaccaaagaaaaaaaggaataaaaaaaaacagagagaaaaagcaaaccacacaatattctcttctctctctctttgtttcgctgatagagagagcctctctctaagcaatttagctcgagcgagaaataatcctgagggaagaaaataaaaagaagaagaagaagaagaacatctttacttttgttctctctctctcttctgttcgattttaatttttttgcagatgcgaatatcttctaaagattcatcaactggttagttctttctctcttcttttttctttcctgatttttttatgttgtttttctgtgtagttagcttttcaatcggaagatttttgctattatgtgtcgaatctctcttgttgttttgagctttgtgtttagttttgcttaagaacaaagtttaaattcatctttctatttctgggtaaagctaaagcttcttttttaatttagatccaaggaaacccatgttctactatatgattatggacgttaatggttcgaattttttagggctttcttgtgattgatttcgctgattttccctcctttttctggtttttgtgtgaattttctttgacatgaccgtttggataatgattcgtgagtttttgattagtgctttgtgatctctcaatagggttgaaatcaagataaggatttgagaaaagatcgacgaagttgttgcgattttgggatcaagagagtgatataatcgagtgaggagaattcgtcgtatagattcgtcagatctggttatctccggtacttaattctccttgattcgtcgttttaactatgctaagttagtgtatgaataaagcggcatttgggtcgctgacaaaaacttatttggagcaaggattcttcaacatcatgaaaccattgcttagagtattcgaagaagaagatgaaaacaattgatttctcctaagtccatctttgaaatttaaagctttgttgtggtgtggtgtggaaatctctgattttggagagctc

SEQ ID NO: 4287 - DNA, 2000 bp, Arabidopsis thaliana
atattatatatttaggttccatacactgtctaattaatcattgtcttatttgagtttggtcatatttggatacggtgctattgagtttggtcatatttggatacggtgctattgagtttgtatcattagttttgttcatatttggacttcacccatttagatctgaacagctcaattaacatctttagatagatgtgctcaacagaaaaattgagattatgcaatttagtgtttagggtttaggggttaggggttagagaaaaattatttccaattcaaatatcatttgcggggaaatctcagactattttcatgcaaaatatatagaggctaatttgaagagggtgcttgtaacaagacccagagaaggattttagcaactcatgggcaattaatgttgtccgtatgtacaaataaaaacccaatggaccgacttcaaggtcgcagcatgccagcatccaaactcgttcaggttatctagctttacatttgaagcaaagacgatcacttgcgttacgattagttagaatatggttttggtaccataaaaacaagatttatatatagaccataagggtttttactttttttttcttttaagcttcgacgccaatatatacatatgtgtagagaccaaaatttggtcgatgaatatacatcaacgacgacaagatataatatatgataatcttcaatttttgaatttttctagtctttgttaacgtcatgcatggatttttataggaaaataacatctatattgacaaaaattattttaagaaacaggaattcatagaaaactcttctttttaaaacatctgactttattatatcctaaagggacaagtagaaaactctttatttgttatatgtcactattctgttacaaatttttattgtttcaaataaaaattaattgcagaaaaaattcctatggaccaacaacgatggttagtcttagtcagcatgagttctggctattgatcagtgatcaccaccaatcaacgtgtcgccattagtcattaatctgttatgaaagtaaacgtatagaattaatctttatcatcacaacatcattctatatagcaaacctggtgcgggtagaacccgatctttatccgaaatatatatctttaccaaaaaatcgaactgaaaaattcgacatcattcttccatttccagattactaaaattcgaacaaaacaaaccgaaccagtcaaagaaacaaagcttaattattaagaaaacccactatactattttgttatttgtttgtttgttaaagactatactatctatatgttccggtcaatacactaatctctcacgatggatcggtccgtggacttttgttgaatagtgatgtccgtggacttttgttgaatagtgattagtgaatgttcatgttttggatattttaacacttttgtgagacggtcagtgaacttttgttgaatagtggatgttcatgttttggatattttaacactttttcttttcctaaagtattttaacacttattcgattaaccagtccaaagtcggtgcattgtagatgaaaatatcatgcactaatacgagtttccttaataaagaattagagttgaatcaaagtttaacgcctgctaaaacaatattctataatcacattcattataaatgattacacactattaattaggaattagtttgatagaaacgaacaaaagagaaaaaacaaacccaacatgatctgcaatcgtcaacgcgcgaagccagctcatgaccaatcacataacgcggttttcagttttgaattggattacaacgtcgtcgttttgtcaaattacctcaacactctagcccctttcgctgacttcaacatcaccatttgacttctcaatccctctataagttactcacgttctcgtatcactttccatgcatctaaaacaaactctatctactaactcgaaacacacttgcggtcttatctaaaacacaaaccaacaaaaagaaaaa

SEQ ID NO: 4288 - DNA, 2000 bp, Arabidopsis thaliana
tatgaacacaatcgaatccactagtctttctatatatatacacaaaccaaaaactaccaaagttccgatgcggtattatttatatgagtttgcaagaaaaattccactactcatgccacttttaagatttcttttctgtgtcgttaattttggacacgtgaatatattatagtaggaaaaaatcatatcatataaatgaaaatataatagataatctagcattaaagttttttagatattgatgaattttttataattagtataccaccacttttaatatatttgtctaaatatcaatcatttagttagtttaaatatgaaaaaaactttcacaaattaaaatatggccaagaaatgatagagttccacgcgtcaactcttttctatttttacattatgcttttaaatggatgagcagtataaataatacatgtacatcttaaatcttaatcaatcaataatacaacctatagtatttacttttaaaaaataaaaaatacaagaagtagagaaaacaaaatgaggatgaagaagatcatgagtgtggtgtggatcacgatgctactaatggcgttatttacgatgggaggcgaagcaaagtcggacaaagagtgccaagtgttgtgccataagcactgtctacccacttcctttgttgcagagtgtctcaaatgtcttggaatatgcgggaggactccaccggttgcagttggaaccatgaattctggtgaacacaaataacaaaaatatgatttttatcttataatatagggcgagacatgtctaggcttccttatattgttatctttatcctaaaattcttataattcaatattcccatttaaccatttcaataagatatcgactcctaaatttcaaacattcgtgcgtacttaaatcggtgataaaacatttttagattatataacttgaacactttggaacataattattttagttagctatgatgtcattgatttcgactcagatatgaagtgttgaacattaagttagactgaaaaagtgtttaatacaatggtacaattagatgtaatggcatggaactggatggtaaaatagttttgctacaaatgagcaagaatttgaggtaattggtttgttcaacaaattgaacaattgtgtggtatactagtatgtcattaaataatgtggaatttgctcaaaggagagcatatcacacacactagttgattaagagatgcttccacagaatcaacgacaatctgaagtcagtaactctgttcccacatttttagatacgaaacacacaatctttaacaaaccccctactagtgatgatgttagtccaagccatacatgatacataccagtttaggtccaagaaagctttactgttaggttagatgttacataccaatgaatctttaaataccaattccaccatcatcaaatcgtttatggtgattgttgtgtaactttcaactacactataaatggaaaaatgttttctcgtggtatcaataaaaaagcttttttttttctttgtttttcacggacgtcatggaaaattcaaagaaagatataaatgacacgcaagtaggtgactttacaattttgctatcgttggataaagatcaaaattcaataaaaagcacaagtacagtttggtttggttgttgaaaaaatctttaaatgatttgctaatgtaggtgttacaacttctgtcaatatttcattttgatttttttaatttttcaatagtatttgtccactataattagtgtaaaaactaaaaatcccaaaaagagaggaagataaataatcattttaagaaaagaaaaagaagttggagatggatacggatgacatgtcaagtccgacaaggaaatacatgcacttgtcgtccttctaatcctttgcccttaaacatcgttaaaaacgacaacttctctcttcttcttctctactcttctccattttcttctcttcttctcttctttgtccattttttgacagat

SEQ ID NO: 4289 - DNA, 2000 bp, Arabidopsis thaliana
aataagcgaaaataatagaaataataaagatggaaaactaacaattaatagtagaactatatatatatatatccacatataaattctttttttttttgaggggtggtttaaaactagctatttagctggatgctcggctattcggatttgtgtaaaatacttctaaatattgagcaataggtaaatatagtgaatatttaaccatgacaaacaataaaacacacacacatcagaggaaacttgggaatgaacgtgaacaataaaaaaaaaattaataatgataataatagtgggcatagagatggttcttcaacgaattatttcttgcccaagtagcaccgtttggttagaaattcttcgacatttatagttcaattaaaaattactactccataattttgggtgacttaccacacaatctttccacaaatcttcgacacgcaattcacaacagtatcatagtttattatcacactttagtaatttatgccaaacctcactacgcaagcaaactatgattcattagatgtgtggacaattacgacgacagcaaaaaaataatatgtgtggacacacaatgacaaactcacattgaactatcttgaaataaatttatactaaatcgtagcgaatatataatcagtaaatagaagttaaactgaagatcataatcaactaaaatgaatatcgtaatcaaattgatgataataatgatttcagacacaataatggtgacggtgttgatgatgaaaaggatctgtggcataacaactgattgaattcaatgcatcttcatgggttttattccgttagctttatctttcacgtctttatattctttaaactttgttatgttattgacatttaaattcatttgtatgcatgttatgaagagatcgtataactacaaaaatataaaggtaaatctttcattttaaaaagaaaatgtttctatacgtgtaaataattagtaaataacacatatttcctcctgcgcgtagcagttcaacaaactctcttcttcgcgtagctagaagctgcaataacataaagaaatgatatatttataaattatgtgaaaatgaaaaaaaatattagtccgcaatatccacgtatcattatgcgccacgtaaacaaagtggacccagaataacccttgtttccagtagaaggaatcaatcagtggcaagaaagaaaataatgaatttcattaaatcgccactctcgagccatcaaagtatcaaacaattgattggagttagttgtatccttcgcctacaaatttttccttactctgttttataagtatataatagttccactaaaatcattttggatacaacctcaatagatctcagcgtattgtttcctgtatgttcaatgaatccatcctccatgcaatctggagactggagtataaaataacacgtatggtatggtatttatttctcatagctagttccttaacagttggaagaatttatacatgacccggccctttaaaacctatccctactacaagacatttgggttactttccatcgacttttgaatgtgcatcaggcatgaaaatcctttaattatgcatattttataatcaatgcttaaattactataaacacaaaaattgtagtgatatattagaaagataatttaaattgttacattgaaaagataataaaaaattataaatagacatctgatataaaaatggatgaagtatagcatattaaaaaaacatatgtttttggtcaaaacagaatcaatgcatagttagctcaccgctacaacaataaccatagggactacgtaccatccataactacattttcttaaattgcatcctctttctaaaattttgcctataaattcacaataacacttcaactttttaggccataagttatctctttctctacaataagcaataaatctcacctcccttttttttttttttgtctcgctacttttgattatcatttaaaaccaaaaaacctacc

SEQ ID NO: 4290 - DNA, 864 bp, Arabidopsis thaliana
cgttttgcaattcttttttcctctcatgaatgatcttaccataagtttttctttttttggtcaaaaccatatgattataatatgaaaaagatctaaataggctttatctgtatgacttggagggtcaaaaactaaagtcttttagactcttagtaataaaatgttgaataagtcttgttcgacgcctcttattgatttattaagaaattgaccagcatgaaaaggaggcattgctactatgtaatgtctgggggggagtttcacatcgatataggctattgatgggccttagtatgaagcccgtaagcccatattgaagctcgagtcttgatggcgcaggagagagagaaaaagacaatcacctgtagtaatctttgaagactcttatctcctctatccaccaagagagggaaaacgaaataaaaatagcacaggggagagacaaaatgagataaggatttgaagcctctcaccactctcctcgttttcgcttcgtgcttatttgtcaaacgcgaacatttcaccgaaacttagcgacttttctcgctttactctttctgggagcaatttctcagagcataggcgagcttaaaggtagctccttttcttagctttgctcaaatgggtttcttagttactcttcttatgtttccgtgataagatggttcgaaatttactagctttcttaatggaaatttttgagtttttctagttagactacaatgaaatttcaattcgaaattgagaaaaagagtggtccttttcttcatatgctttcagattagtctgtgttgttgtctgaggaaagcttgtaattttgacagtgtgtaatggttttctatgtgtaggtgacagttcttagct

SEQ ID NO: 4291 - DNA, 2000 bp, Arabidopsis thaliana
ataattttgttctagaacatgatcaatccattgaacagattaaacgtatagttgaaattgaaagacaaaccaattcactttcgattaaccatttttaacatattccgtggtctgatcttgttctcgaacaaagtcatcttctttggacttatttgaggttttgggtctgatcgttcacgtagcctttgcaccaaagtagtcatatttatctgtagtagaacaccaagatctgtttgtttttggcttgtgtttaaaaatcagctttcgattaaataaattacttttttaagagaaagcaggttacagtgggtgatgtcgtgcgtataagctatgacgaagtgtaccaaattctatttaaagtcgttggaacaaacaattatgtgatggtaagtaaggtgacatcgtcacccgtaacgcccacacacacgtacgcattatccactaatgctagtgttttttttgtacatgatctaattgtaaaccaacattgaatgatagacaaatataaatgagggcaggtgtttatccattcacatagatatgcgttacaatatcatccagtctacgtgtagaaaaactagaaattttatcacttctatcaaatttaataatgtttttgaaaataatttgtttacaaataatggatcggtgatcaataattgtggttgttgaaatataaggatggtcgaagttaccttcattcattgtcctgtacagttttcatccttaaacataatcattccccatgatccaaatgttatacttgtatgggacacaaaacctgaatttgtacgaacatgataagaatatatctacataccaaaggttgattaagtatctcatataatcttttttttcatatatatatatatcttatcatgattggattcatatagtttaccatcacataagcaaattttaattattatagagattttgaatgtatgttgtgacttgtgagcgaagcgaactaaaccgtaaccagattaaaccactatatttttagaaaatagtactaatcgccacggaccaaatttatatttatgtagaaacggttgtaattagtccgcgccatttttttttccgatctgcagtactattagaatgctactatatactatgcaagccgcaaacggatttattcgctataacgaccacgaccatatgagatgtgataaaatcatgaagtactgtagaaaaatcatgtagagatttttcttttaaaattacaacgtagttgagtggttctgtggtcgatatagtcaagtactcaagtcacattagcctattttgagttcgaaattagaatgtggctaaaccacaagaccgataactccaaaattacaatcaaaatcaaagctcgtaagtcgtagttaccaccaccaatccattgtcaccgtctcatcaatatacgtagctttctctaccattaaaaccaccacgtgtctcattctgtcctaccaaagtaccaataaaatcattaggtccaccgtaacaaataactctgagaaacacttgataactccacccaccttcttctcctctcctttattaacttgcttcttctctcggctactactatacccgcgtcttcatcactctacaaaaacttaatcaaactgattaacactaatcctttctcttaatcttcttctcccccgccattcttcttaaatccgagaccaagaagacgacgacgatgatgcaattgcaatgcgtatacgcctgaccaaaataaaaagcggtaatcaaatccaaatccaaccactaaagcaatacatttctcaacaaaatcatagcaaaagcgaaagagaaagcgaaagcaatccatttgcaaaatctgtgtaggtgtgataaaatgcagtaacacaaaacggtgaagcaacaggtgaatcagaaactgaagcaaaaggatgctttactgtttctacaagcctattcttaataaatagatcatatcgatctctcaatcagattagattatggaaattgcagcgaaa

SEQ ID NO: 4292 - DNA, 2000 bp, Arabidopsis thaliana
ggagcctgccgcccttaatcacatagtcgcatgcattaatacttactacatagtttaataactatttctaagtcaaaatttattctttgaaaaaaacatttaaaaaagaattataaactctttcccaaattttggataatttgttgactttttttgttgttaaaataaattgttgactttattgtcaatgattattgtcaatgtgaccatactcttcttttcttggtggattgaccataatctttttttgataagagtaccaaaattagtaaaaagtttacagaaattataattccgaattgttgagatatatctacgtttttgaatgttgtaatataattagtcataaaactttttactatgattctctttaaattcagttctttttaagtttaatgacaaaatgtgagattttttttgttttcattttcgatgaaccccatatgttttaaaatgaaaaactgctatcctagtaaaagacacgattgtattaaacgttttgaagtaaattttcatacataatccaataacaacagaaattcttcgtctatggatttttgaaagtagatttatagatgatatgttttcttcaaaatcctatataaaaataatcgaagtactacaggatagattagtttgttttgtatgattaaccggtagagttaaatatgtgttttaattggttatgggacaaagtcagaagactaatatggcacgtgacgtgaatagagtctttggaagcgagaatacgtggtgggtcagcgtagagaagggtcaacacagatttatacttttttttgttgtgaattaatccagaagccagctcatcaacatcaacgcttcaacttcaacttctacatccttgaaatatctgagtcctatatcattgagaaacagtcaaaccttctctttcactatgtacctttgacaagttaagctcattttctccttccaccatttatatcccaagaaagatcattttgtctcatattaggtgaattgctcatattgtcttttcttttttaacttggatttaacgggtttataacaaattaataatgatttttttatataggaaaaaaacgttgttgtattatttatttctcttaaaagggactattacattttagcaagatcgaatttccaaggttttaaacttcaaaatgaaaaatattaagcaaagaattagaaacaaaaatcgattcaacgttatgtggaaccataatgcaagattttggtaaaccgtggaatgtctcaccatgtgtacttttttgaaaaaatcccaaaatcaacaattgtgaagagatcttcatgagcttgattcgacgtactagagtatataaaaaggcaaaagataaatttgagacgatggatctagtcatcaagtagaaagacaaattgatctctctattcatgactgtgaaggccattgatgatcaaatagcatgtgaaatcataattttgcacgtgatttatcctaagccaatcagtaagttacctagctacttattccattaaacgtgtttaaatttatatgtaaactgtgttaaaaaggaacaattgataagcgcaatcataataatactaattaaattaacaaaacagtaaaaagaagttcttgaaaatcgtcatgtatgatgaaatgattaatactaaataatgtttaaagaaatgtcatgtcatttaaaccccccaaaaaaaaaacaaagacgtcacattcaaatgtcaaaaaatattcgaggaaataacgcacgtgtttccaaaaacacagatcagaatacgtcccgtgtgaaaagagtgtgtgccagttaggcacgccacgtagatacttgacaaaaacacggagccatataaatagagcttctttctcactttcagtttcccaaacacaaacaaaactcatattttcaatctccaggtgctttacaccaacagagtcgcaagaaaacaaaaaccaaactcggatttagtttgacagaagaaggaatcgagagtcgggt

SEQ ID NO: 4293 - DNA, 390 bp, Arabidopsis thaliana
agacttagatggtttattttgattatctttgtattttgctttaccaaaatgattcgactaggtttatgacatttggtacttctatttgttaattcatttctatatcactctttcttttgcattgtgtaattttataaattcttaatatatcgtttgttttctcttagacatcttctaaaccacgctagattcacatttttgactttattaccggttagtcaacgtggacttaaaatcaatttaataacactatataagccaaagttataaacaattaaaactcttggggttagaatgcaaataatgaacaaatcgatgcgtataaatatctcccgataaagccctagaatccaaggaagcgccgagagaaagacagagaagagagtgaca

SEQ ID NO: 4294 - DNA, 2000 bp, Arabidopsis thaliana
tggtaggctaaactaacaaaaagagattacaaaacttataatataatttgatatatttttaatacttaaaacctaaatataaagttatgatttagtcaactgtctaagttgtgacatgtgcgaaatagaaataccatttaagattaggaacatgatgggatgatcttatgagtgaagtctaagtataaccaaatcaaatcaaataaataaatagattgcgatttgcaaatgatacggctcaacacagctgtcctcgatccaaattattgctagtcctctcgtcgtgtaaaacgtgatcttttcttttttaaaataatcatactctagaattttttgatccttcgatggaaaattcgtgtgtagtagattaaaaactgatcactctaatgtaaacaaatgtgaatcgaccctggcgcgaaagtactggaatctacacgtaagttgattaatgattcacactttcttaatgccaataagtgagtatctcgtaatcttgtaaactttttaaaattttaatgagtgagttatctcgtgattaatattcaaattatattcttcagtatcgatcgtgtcatgtatggataattggatatacgcaagtcttatgacacacaataaaatatgaggaaatttgacgtaagggttatatgctggcggcatttgagctgtggaaaattgaactatatatgaggaacatgctaattaaacagcttcagcggaagttgtgcaaaacacgttttgatgtataaatcgcttatactaattctcatatactatataaatcgggtcttaattggttgaccaaattatattttggttaagcgacacatgtagtggttgtacaatcttctcaaatctcattgtcagattcagatagatattcagcaatatataatctataaaaaaacatgtgatagtacttgttgaatatatatatatatatatatatatatatattatagaagcttaattattagtctcacaagtcacaataatgcgaaacaaatgtgattgaggcttgccatctactacaattgtgtgcataatttatgaaatgggacagtctggacataatgagaagaaaaaaaacagagaagaagagataagctgtctcctttgcccatgatattcaaaccattatttttctgtaataggtccatgtgtgtttcgcagtaacaaaaaaaaaaccttgttcttggcaccaaagactatctatttcgtagatattatctttatatatgttttaagattcagtgagattagttgcctttaatattgacaaattcagatttgagctattcgacacatggatcttaattttgatatatgatcatatcctaaaccatcacttgaatcactttggtttatgttctttgcatctaattttgagaacctatattctgaaaacgtaatttctccaaataactttttcactttcttaattttctttagaaagtataatattctttactgtttcttttacataattctttactattttattttatactaaagaaactttcatttgtcagactctacttcttgttgtaattttcctacttttcgaaaactgtaaaagaaaataaactcttcttcttatctgtgttcaagaacctccgttttggattatagatatgaatgatgacacttaagtacaacttttatagtggtcaaacttaataaattccacttaagacaaagaaaaacagtaagtgttaatttgtcttgaacttactgaagtatgtaaattccgtttgcgtaaaacagttgttaacatatgcaattaattgcgtgggcgttactccttgttacaacaatgcccctagcatttgtcttaaatcttgtattgaatacctaaaacacccttctcttctcccataaaccacaacattacccttaatcatcatataaaacgtcttgtccctcttccatagatttccacagaaaccaaaccaagagccggaaatcaaaaacagtaataaaagatcaactgcaagaaa

SEQ ID NO: 4295 - DNA, 2000 bp, Arabidopsis thaliana
aaaccctgggattttgggtatctctgagcacgaattctacattctcatggctttcgaacacagaaatgaagacctaaattccttggattcggaagaagatctggagaaaatggagtcagaggtggagcaaatgtcgcgcaaggtttccgagtacaggaaaagcctaccgagtaatctgagcaattctgtgatttcttctcgtagatccaattttcccaacatcgattctttgggctttcgcacaactagcacaggttcgtacgtttctttgcttatatttagttagataccttccttctcctttggtttcagctggaattttagtctctttttctttctagatgatgtaataatagattgatcctctacattattcgtggatcattcttgtgaagaccaagttgtttagcagcagcagacttgccttttgattgtgatgtcgttttttgcatttaggtttgtgtcatgccatgcgtgtagaatattgtgatacttgctactataccctctggatgattatgttcatgagttattacgcttaattctgaggtgatgatacatatacaaggcttttccattacaataaatcatgtatttttgtggcttagaatcgacaagcatgagactatgtgatgatatgtttagctaagctgagagaaaatgattgtttagccaatttttgtttacagataccatgagataagtggccacattaggtgacactaagatttcatagcattgtaatatacacaagtctctagtgaactgctgttgtgataaccaactcatcagttattttgttccttgcaagtttggaagaacctctagtgtcaagagatggagcacatataggtggaatcgaacaagaatctcgagatagcctgattcagctcaaagaaagagtgtacgagaacattgccacagtgcctctagttgtagagagaatgcgagagagtaaagagagaatcgacaagtccatttctttcaatggaactactatgcacccggctttcacaaggcggaaagctagctaactgatcagtttctacttctccctattggctttaccactcaaagaaagctaatgcataggaggagatatggctggtatttctttctactatattagtatcaaccaacatctctcgcatttagaataagagtataccataacctctgttttgattgtgttctacattgaaacaggtctttctctgattttaatatggactcttatagaatcttgggctgattctacaccctgtatgtatatgtaagaatcacataatcagatggttgcacaattgtcaagaacacccaaatccaagcttgcgatttagcaatctcacccgtgtaagaaacttaaaaccataaaaccaattgatataagagcttttctagcaaaaacttaaaaatataattaacaccgtcgaaaatggtggaggctactagagcgagatataaactttatcaccgtttaatcgtgtgggattttgaaatgatatgaacctattgcaaaaagacaaaaaaaaaatataaacggaggaactaggcagtgggaccggagatccaccgaccggaaacgaagaatccatagtaagatagagcccaggggttcggtcgtatcggaccggtcggatttggattctaacgacaagtgagtggacccccagaaacgacagacgtaagcaatgacaacatcaaactcatcgccacgtcagcaacggagttctacttgcgaaacgtgtcccggcagcgtcatccacccacgtgtgttctagaagctcttctcctcctccgtatctcgacacgtgtccactccctctccttatataattgacttttctctcattctttccaagtttcaaaaacgccaagtttcagaggtagagagagagatactacaattgattaggataggatcaggatcatcctcaacaacctcctcctaattcctcctccattcatagtaacaataatattaagaaagagggtaaact

SEQ ID NO: 4296 - DNA, 1344 bp, Arabidopsis thaliana
ccagcgttttcaacttatttggaggaactaaagaccgatataaggaggaattcacaaagttttctttatctttaatttctcgaactgcaaatgtaaaggcggacaaattggcacgaaaaattcatattgaaccgcttcatgtcacttttataaataattttcctcacaattggctcttttgagctctaaataaaatctgttgacaaaaaaaaaaaaaaaatcagaaataaagttcatctatgactacctaccaaaacaaaagttcatctttgattcactcacaaaataatacaaataaaacatgaaaattataaaaacatttaatattatctcttaccataatttatttatttgttgtacatagtacaaataaaatggaaataataattattttttatttgtaacgtttgccggccgaataaaatattaaatttatttgcaatactactcacaacaaactttacaaataaaacatgattatcgttttttcttttcgttcattcaaactataaacaaaagcaatgaaagcatgataagaaatgatattaaatgtttaaaaaataaaatttgatataactatattattggaaacaaagtccatatttaagtcacctataaaaaagcatgatatgaaataataataaatgtttaaaataataatataatatctaatggtatttgaaataatgtatgtgtttgaagatgttataaaaatgttaaaaataaaaatataattatcaatattgataataatattcatattgatatgaagaaatgatattatttccaactacaatttatttacttttcaatgtgatgtgaataaataaagaataatcatgttttagctaatgtttcaaaatagaaaaattaatataaccaaatactgtaacctaaaattgtaaaaaataccactctagtaaataccaatattaccccggttagctgctactaacattaagggtgaagttgtcatttgatacagtgatcacgcacttttcacttgtcttctttattagttttttttccttgttttttaaagacatcacttgtgaccaaaaaacaaatccactaagaaagaaaaacaaattaataaaaaaaaaagatcagaaattagtttgtgcagaaatcgaattggagaaaccgagtaactatggtagccacagatgagttcatcgtttttgaccagatctgattgttttcgtctttgccgttgaaataatcctccgctccttcttctcatcgatttctccgatcgcgattttggtttctcgctctcctctctcgctgtggattttgactccgagagaaggtttgattttcggtggatttcatctgacagac

SEQ ID NO: 4297 - DNA, 623 bp, Arabidopsis thaliana
ttatgtctttagactcttgagaacagattatgcattgttagctccattatcattgtgactttttgctctctctttttgttttatcaatttgttttatgcgactcgctttgaaaactttagcccattctgtattgagctctgaagattcgacgagttctgtaagttaccgatcacagttaaaagactttgatatgttaaaacccttatattacagctacatactatttttgtcttaactcttaagatatcatgcacaataatatacttgttttgtcttaacctatcgattacaaaaccgggttaaccgccgacatgaggcgaactctaaagcctaacacgcgtcaacatctatcttctcaacgactcaaaggctttccaacacgtgtaggaccaataactgaaacacaaagcctaccacctcttcttcctcttctttcatgacacgtctcactgacgtgtcgtcaagaacgtaattaaatattaaactatcgtgacgaacgcgaggcctatggctatatctatgggacatgctcggtgagcaaaacaataaacaaaagtaatcagaagatatctttgtaacatctttgaatttcgctaaaggaaaagagagagatttggtaaaa

SEQ ID NO: 4298 - DNA, 2000 bp, Arabidopsis thaliana
cttaatcttggttataaataaaacaaaatttgttgcaatttcagaactatattgcaatcttgaggctttctacaaaacataataaaaaacttacacacaagacagttatatttttggaaaaataagaattgaaagcttgatttaaggatctcttttagttaggtaaatctttaagatcaatctactatcagatggcaaaaataatactagatactattccaacttcaagcgaggttagcagttagagtgtgggtcacgtacaaataatttcttttcatttgtgtagcttagaattggccggcattataaactttccatccaagaaatctataacaaaaagatataacaccagacaattgattatcgttggagaattttcatattaactacatcttcttacaacgagtctatataaccatttcaaacttaataccatcagaaaatgtaaaatttaaaatagttattcaaaacttaaaatagttattcaattatataatcggttactagctagatcaagttagtcggcgtagaagtgaaggatccaataatatctggttaataatgtcgacaaacattgtatacttacatgcaaacatatacataagcatatatatagtttatattattatcaatttggtcgtatatgcaaagagcaagttgatctacataaaacgaaacacaacagataagtgtttattttttcgccaactcatgactctaaagataagtatgccattgaataaaggaaagtttcatataaactattacattgatttgacaattacctgcttacttgagttagacatatatttgggaaaataacacgagaatgactcattacgtcattcgtttcatcatctttcgattaaaacacataagtatatttactccccatcaaaaaagaattaaattttacttgcatgtggctttggaggtttatggtatagttttttgcatgtgggtttgacattagagaaataaactgtctgcatgtggtcggaacatggggatttccaaaagatataaaattttacacttggcttgtgggttaacctatatgggtttcgagagacgaacgttaaataaagcatgttgcaagtaatatatcaaaattttataatatctcttataaaactgttttgtttggaagaagctaaaaccagactattagtattgagccgttcatgatgtctggaagtttctaggtaggtactgtctaaagtatcaatcagagaaattgaaatcattcacttatcattttgttcttctaagtgatgaagtgaaccaatactatcacttatcatttactaatattgatagttataatactctgttcgggttgaaaaagcagacaaaccaaaataaaactatatatatgtttactttaatttcactcaaagattaaagaatttagtttttaattgaattgaaatgtgatttagaaatttatatagtctctttaactgaaattttattgttaatgaaataatatttttttgaggctaacagttttcaaaagtattgtagatattaattatatttatattttttatataataactatataaaaaaatctgtagcatatttttaaaaaatacaaaagtctcacttttaagatcagtggatcttatttaaataaaagtctcgctcctaagttattctggttttacataataatatttaacaagtatgagaaagtaataggtaatggtgggagcaaataacataatgcccacacaagttctatgtggtattatttcattttctcaccacttgccaattgttgatttgtctctttttatcttcttctttctatttctatttctatttctatttaatatattttttttttctttctacttgacaatccaagcatcacacactctcctatatggctatatataaagtgttataaacagaaataacatacataaaaatcccaacatctcctaaaatctcccaaacttttaaaaagttaaccaaaacccccaaacaaaaaa

SEQ ID NO: 4299 - DNA, 1798 bp, Arabidopsis thaliana
ctctgctacttcttcaccgagatgtctctcagtctcagctcaggttcattggctgggtttcgtaaatagcctaattatagataaagcacgaggcccaattcaacaatctaagcccagcccattaacttaaaatctgtaagtatttccgatgatttgtttttcattttatttttttccagatttggtagaatagaaccgtagaagtatttcctggaaacatcccatgcatctctatcactacgtggaagatcagaaattaaagaaagtcttcgagctagagttgagtggtactccaatctttgtacttttatctttcaaagtctccaatttcagaactactatagcttcgaggaaagtcaatggtaaaattttggaagtttattttctacaattctataaattttggacgtacgtacgacatattccatgtaaataaaacgagttgaacatgttcatatcgatgaagacatataaaacccaaaagtaacccttatcactccttaacaaaataaaattttgtctatcgtgtgaacttgtatgacttgaattatcaattgaaactttaaagatataaaatttcagtagaaatagaaattcttttacaattttaaatgtatatgttatgtttgaccatttgtaggataatgtattcaatagtctcataaactatactttggaacaaataaaactgcgtctgaacgttaatgatagacaggtttttgacaaaagaaataacacgatttgatttttagtatttctaagatagaaaatacatgtttatattggacaattcgcaaattgacaacttgacgtatttctttgaaccgtttgactttttgatgaattaaaccctagttcaattctttcataatcctcttcttggatatagaccttgtgtaaggatttgagagaattttgttttcaaatgtaaaagtaaacccgttgagtaactctgaaatagcagataattttatagcaaccatacatgtctacatgccgaagatttaatttgtcaacacaagtgcatacaaagttttcaaatgtaaaacgtttatgctcctcgcaaattttgacattcgtgtcatcgtgtgtaataattctacatgaaccattgtgtgacctaaacttcaccgttagataattaatacgtaaaccctttaaaattattgtgtactaaatatgtagttatttatataattaaataagaacgacaaaattaatgttggaaaaagattatgtgaattgtccttatctcaataacttccatgaacttaccttcgttagcctccatctcttatggctccccacatactctgtctcctagttagcctcctctcactattttgtctcttttggtaatattcaacaattcaaacacgccaactttgaatattccgtaatattttttccatattcaacaattttgcaaaaacgaagacttcttactctctcaatagtcttcaactgcctacccttacttatatttatgttaagatctcttagtcatcattatattcatatccctagttcagttttatctccaaagaacaaaaatcattcttttattctttattctttcaagcttctctgtttcttgtctaaacaaacaccaaggaacgtttgttttgtgtttgatacccacacaaggtacttttatttgttaaaatgtttgaatgagacaaataattggtttggtatagctaattttaatgcgactactgtttgtttaattaatgtgtgcaggggattttctatattaaatatactttggaattatcctttcgttatattagtggtc

SEQ ID NO: 4300 - DNA, 652 bp, Arabidopsis thaliana
tacatttccaaatgctagattcgagagagtcgatttgactgcatctggatccatcttttaacaccaaaaatctgaaacaacagcatgaaaaaagcattaggattcagagataaatgagagctaaagcttcaaaatcatacctttttcaattccttcctgatgcgaagaagaaaaataaaaaaacacagcttgagaaatcgaaatcaaagcttttttcctttctttactaacaatttcaaaaaatcaaaagatgaacaacaaaggtggaagaaacataccaaacgacatcgttttttagtttagtaaaagatatgcattattgggcctttcatatctaaaggcccacaggcccatataagttaaaattacgtcggtcgctaaccactactacaccgacgtcttacttgccatgtgtgtgtgactcttaatcaattacgaattgaatatattacttttacgatgtcggccaacacgtattgagtaaaatatctatgtgatgatgaattcctatccaaaatgaaatttgcatctctataaaagtatcattcaagagatcattaatcttcatcgatcaaagtcttgaatatttcatctatatatacctaagaaagaaaagagttaaagaagtatattttcgattcaaagaagaaaa

SEQ ID NO: 4301 - DNA, 466 bp, Arabidopsis thaliana
tggtgaaagtgagaggaggagggagaagttcgttgtaggaaataatgaaagtgttgaggaaaaattggtaatttctcgttatttgtcgtcttcttgtttttttttttaattgggggtgaatagttagtttcctaaattacaggcctgcggttaaaatttcttccactaataaaattaggcaaaaacaaaacattgcgattaaaaaaaattaatcgtagtaaaatcatgtattatattcttctcttttcatattttgaacatatcacatgatgtttagatcttataaatgcagtaatttaatagagagattagaatttggaagaaaaaaaagttacatgattaaacgaagtaattaatcaagttgtaagtagttattttaaaaacaatattagaaaaatgttttttggttactcatacagtaatacttaattcgtcaactgtgtcagtgttacaaaaaggctaaaag

SEQ ID NO: 4302 - DNA, 2000 bp, Arabidopsis thaliana
aaaaaaagaaaaaaaaaactaagagacgatcataagagttaggtgtgacctgacaagattcttgtacacccgaacccgacttgtgaactgtgaagtcaacctctaattaacagttattttttattcctacaaatacggatccaacattattctcaattagttgaagtaatgtctgtctatttgcacattttcaaacccataatcaaacaaaagttacatatcctgacccgctgaccatattatacactcatctgtgtatatctcaaatctcacttgcaggtaattctctctagtacttttatgtagatatatagatattagtagaatgttagcaagaaaagatgtaaaacatatatatcaactatattagaacccgtcctttgtgcgagtttttgatttttatgataattttaagttaacaaaaactgaattaattttgctttatatattaagatgtgtgtgaagctcaatacacaatattaatctattcttatcaaaaaaatttatattcaaaatttacagcaattataaagaactaatagcattgtattatgacttatcattaagatggggtttgtgtccatgtccggagttgttaaaggtttgaaaacccagagttatgaatgtaaagaaacaagacagaatgcttgaaaacagagcatcaagtaaatgttttgtgtttatattattatgcagctaaaatggaaccggtgacggcattccaacttggccaatggatgtctagactcgctatattcttcaaggcagacgacacattcttccccaacctcgaaattgaattcctcgacggcaacaaaaatatatcttcgaacgttttgttgtgtctgatcagccaactccacatctttaggtaaactctaatatcctagagaataatagaaatctataatactagttacaatgtagaagaagagacaacctataacgaagctagatactatagccaacgtaaccaaaccaaacaacaaaagtatgttgtgatagaccagtttttctttccaaaatacggcccaattaaaagtttggttctaaaaacaatttgggccttagtttgtatagtttaaaatgtgtttcttagtgaggattggtttttcatgcccttttgtttgtgtgctcctttttttgtatattgaagatcatatcaaagcaaaagcaatacaatacttttcattcaaaaagttcctccttctgcttgttcatcaaatctctcaggtaattaaatatatggttgtaccacttttagttttgtggtattcggctctgatgttgaatacttcaaatatctagatttgcatctgatgcaattgaaaaccttttttttttttgcaattgaaaactcatatatatagtatggctagatatatgcaattgaaaactcatatatctagccatactatgaaataacaattgaagaacttctaagttgaaagaattctcactttgtatgttttgatgaatttgatcttacattccaatcgttccaaatatcgaaactcttaaagcgtattcaatcaaacgaatctcgtcctagatataccttggtcatttcaagaagaagagaaaaaagttatggtcaagaaactaaaagtctaaacccatattataattctagtgttgatatacgagaattatatattggtcacttgcccaattaaaaatatcgtgtatagaaaacagtcaagtcaacaactatagcaaggggcaaaaccgtaatttcacaacaagcaacttgctcggttttttcgttatcaccactcacatgaactctgcattaaaaactctatctctctcaaatcgaaaggcacagcccaacttttcgcaagtcgctgtaaagtttgatttgcttctttttatatacacacatacttctcctccatacactttcctcttcaatcctcagttttttttctaagccctaataccatctcaaagaagagatcaagatttgaaatcaagaagacaccattactcagatcaac

SEQ ID NO: 4303 - DNA, 829 bp, Arabidopsis thaliana
cttcatctgacctcaacaatgcaataaactttttttctttgattttttttttctcagaaagtgaaatgaatgatgttcaatgtttataagtgatggctctagtaatagacccaaagactgtcttacattttgtggaaaaaagaaaaagcttgacttaacaagtctcttgtaaaaaaaatggcgtcatcttccacaaagatatatgaatttccaaatgaacgctccacaaagtcaattatgtctcctcttgcataaaagtattaaccctaaaaataattcaattacttgcggtgtggggttaccgcagtacaaaaagtagagcgtgtggggttacctcagctgtgtggtgagtgctacgcaattgcgcaaacgctctttaacggggcacgctcgtgactcgtgagagagtcagtcacacaccgtaaaagttaccgataaactctcaaaaagtcttttttggctttgccaaatttctaaaattcaatcaacattttctttcttcttttcgtttacatttttgtattaaaaaaaaaactctaatgggctcgtggaggtagctgaagcccaaaatatgggataagggctataaggattgtcgatcatatcttcttgcgccgtcaaaaagcttccagtcgcaaacgatgacaactttccattaaactaaaatgacataaatacccttcaaaatccacatattactctcaactgtttcatctacctccctccctctctccccattcccaaactacacattacacattaccaattctcatattaaaatccacaaaactcaaatccccaaaataaacaaaccctaaaattcaaaaca

SEQ ID NO: 4304 - DNA, 2000 bp, Arabidopsis thaliana
catatattgatatatatagctttcgtggagtcaccattgagaatggttggatccagtgcaagttccatactcgaaacttaatttgttttcatgcaagttgctccataataagatacatttatttgtttaatagggcagcaatatttgctttgtcagatttaaaatattttcaaattcacaacagttaaacaaatattgccgtgataaatagtaattattagattaatttttattttttacttattttagtttgaattgaaatcttgatccatactaccaacaaaaataaaccactaactaacatactacgtgtagttatttttaagttttcatagtttattttgttatgtattaattacttttaattataagtgttgattcgatattttctgaggaaatctatattaaaactcaattatataccatatttatttattttatttaataaaactataaattcttacaattttataaataatacaaacttgtgttttaggaagggatgttaaaactttatggttcttttggaatttttttaaaaatcaatggtagttttagaaaacaaaatttaaatagtactatttgcgacctttgatatatcaccctatatatatatatatatatatatatatatatatatatatatatatatataggtcatttgataagaagcttacgaacaaattatcttctcgtaacagttgccattttagaaagaaaaaaatcaaattccatctctcctactgccaattggaaaattaaaatcttattatgcaagttactaactcctctggttagtacatatacgagttgcataacttactgttattgttctttcttagttaggttagatactattgcagagtcatgtgcttctgtgtactccataatatataatttgagggacctattaaaagactaacaaaataaaactgttgaaatgacttgcaagttacaaacagagcaccaaagtgatacgacgaatatttcccatacaatgtcaccactagccatcattattggtgaattgattagctgctcaaattataagccgaatagagaaattaataatatcgagattaatatatcgttaaacaaataaaagtaagcctttgaataaaaatatgtagaggtccacagtgattagaccgaccaaaaaataacaatatttaatttcactgctataagaaagtttatgacataatgataagattcaaagaccaaaatagtagaattctataattagaggaaaatactattttcttttctcattatactatacttgccagcccattttgtcatttatcatgaaaattaaattgttttacatatcttcatttaaatgtttatagtaacaagttggaccctcctcgttatcaaaggtaatcgccttcagtgtttaataaagtaatacgattgaggacacaaagtgaatggtttaaaattaatttccgtgggatttaaagacgaatacaatgtgatcaaggtggtttgacgtctaactatagctagtctaaactagctagctaggctaacaaccagtaataatagctgaccaatcatcaacattcatttctttggatttaataaagaagctcaataacatcgactgactaattattaaaatgataataaaaactatttagtataataatcgtcgtccacgtcagagtttcacctctttctctccggctttgcatggctctttgtttctccttatctccctcccttacctattatacttcctctacaatttcattgcttcttgataagagctctctcttctttctatctcttgttctttaatttgtctctctctttttctctagcaatgcttggaagctatagagaagtgagtattagtgtctctctctttactttcactatctctgtttagatgtgtgtgtcggatatataaccggactaatatacgtataacttatagttattctatcttgaccattgatatatgcgaatcactctatggtattaataaggtt

SEQ ID NO: 4305 - DNA, 2000 bp, Arabidopsis thaliana
attttgcaattacaagtaaaaacaaaaaaaggttttgatgcatggttcaaactaaattgttcgattctttaggttttgaaggtttattatgttttaggttaaggttcgaatctactttacactaaaagtatgattgaacattataaatattataaatgtaattaatatcgataaaaaatattggccattagtttggtgtagtttggcattttgtttgaatagtaactagattaaaaaattggcatgaatagcttggttggtgaacgtaaccgttcggaaatgagttagcaaaatacacgaataactttgggaaacgtgttaacgaacacaactccaactgtctatgtagacgttacaattttaaaacattaatatatttttttcaatttatggaaattttaattcgagttatagcatagaaatgtcagtaatacaaacaattttcttataatttgttatttatttaaaatattacttaaaaataaaatatttctctcgtgtaaaaaaaacaaacaaagatttcttactatcttataattttattcagttcatattttcttataattctttgccgatccctcaaaagtatattttaattttatgtttatatttgataaaatttcattacagatccctcaaaataaatttttgttacgccgcgtccacaaaagaatgtttttggggtatttttatcatgttacttagtaggttatttctaataacataaataaagtcaatactttttatgtcactcatatcagatgttttgcaaaacatttatgtatttaatttttttgatcatttgtatatgcagtattctatgatttgttgagttgattaaattaaaatattaaattatcattttgaaacaaaaattcttaaatatgcgtttttagcaaaacataacttagaaaatggaagataggaagtatattaatggcatttgaagtaaaatcttacaaattaaatgttactactatttttctattttgttggtcacttaaatgttataatatttacagcatattcaaccagcaatttaccaaaacaacaaaattgattctaattcaaatacaaaatctggtaatagtagtttaaaggtatactgtatttgatatgttattttaaaaaaatatattcataatcttgataatcgactaaatagtaaaacgttttggcatgtcccaataaaaaaataaggatacatttcaaaaatgaatgtgtattaaattaccacaaatatttagtagtactattagattaggtaaatgattttagacttctagtacaataacaatgagtactagtactattttctaaaataatatgtctttttggaaagtagcaccttattttactcatcataacatgttttagaaaacataacatgttatttaaaaatcatcacctcaatttaatgttgtttttaaaaatcatcacctcattttaatgttgattttttcttttaaaatttatacatttacttaatcaactatcacaatattatagtcatgtatctgaattacccaacaaaataatgcaagacatctataatcataattgacaaagtcttatttcgtatgtacgaaaatcaaataaagaatctttttgtcgatataattaaggtacttcatgtcgacaacataaatatataaacaaagttgaaattgttggctgaaaatgaggaatctaaagatcaaaataatgcaaaactgttttttaactttatcaaaaaaccttcaaatttttttgtcacatgaattgttttcaaaacatttcttgttaatttctgcgctcttcactttctggtcttgaaaatatgttttaactaaatattagagaacacatgtctctgtccagaataaatgagattaagaaaaaaaaaaaaaaaaagaatctctatttaattgactcaaaagttttctcataacacaaactcatctctttcctctcaccttcctcatacatcatctctctttctctttgtctcctcatcaaca

SEQ ID NO: 4306 - DNA, 2000 bp, Arabidopsis thaliana
aactctccctttttggctaatggaatctctacgatcaaattgcaaaactctcatcaatgtgagcgacccggagaaccaaattgatttctttccaagtagatcaaacatattagaccatagtaacaaatgattgacataatgttcaatctttcagagcataaactgtttcggatgctgcaacagagaaaggcgtttagttgtggaagtcgatgagccatcaaagggactcaaaatccaaggaaagatagtgaagaaagatagtgcttcatcagatgacttctggagcacaagtacgtgtgatatggaccacaatataacgattcagtcccaatcttcaaacccgccttttgatccccaatgcagcacaagcaactctaccgaatttgtaaaccatggtaacttttgaatgttctaacttctaaggcctaggttgttttggatgccaaaaacttatgttatgaagcaagcagtatttattactcattcagttattctatacactaaaagatacactactacttattcatttccttccataaaaggacttattttgtggaaccacacgagacaacaatggcgtgaatgcttaaccagacaacaatgtctagttccagaacctgcaataaggtgacaaccacaaacagttacgaatattgaacgaactatttttatgtttatataggattggtctactgaattcgtcaatgttaaaatgaaactttgaattcatatgatttcagctggaactcgacgtatgatagcttattgagcacaaacaagctttttcctcaaccaatacctcttaaggtgatttgatttggttaattagttgttttctgctaatcataactcttaattttaattaacttacagcagaagattctttatcccccttagaacattttcatatcaggatttgaatctagtatatatcattgttgctaggaaagttttttttaaattgatgatgatattggtacaggagatggtgcatttccttgttgatgtttgggaggaagaaggcttgtacatatgattcattaaaaaaatatttttatactatataaagaaagcagaaaaacacagtttaattgcttttttcaagttccatatcatttttagtgtatatttattgcccttttataaatgaaattaggaaatttggatcaccttatggtcaatttctttatttttttagttataccacatttatactactgatgatgaaaatcgattttttgtatcgtgaacacttattaactggttttatcttgaataataaaacttccatagttattccgttattgttaggtcattgtaaaaaatcatcagcaattagtcattaaatatactatcaaagcttgtcagtcatttctcatcaattctagcaaaattattcgatatatccaaatccaaatgtcttggtttggtcatgactcatgaccgtggaaataagttcaagaatgcaaaaagtaacttatttgtgggacagaatcaaattctttgatccagttacttacgtctttccgtagccaatcaaattgaaatattttctttaggggtattcgattatggtggtcctgaagcctataacaattgttttccgataagatttgatatatataaataagggaacaatccccaaaaatgatatctagttaagatagtcgtagaatttacagaaaaggctacttatgtttttggcctgataatgcaaatactttcaaaatgttttatttgctaactagcttttagtttcgttctcgtatctaaagttagagattaacttactattcttgtattacgataacgttttgaatgaacatgtaatgatgcaagggtgtaaccaaaaatgataaaactttggggtcaatttgataatattgactaatagtgtggggcttgacaagaaccggaaactccatgatatttttgcagtctaaatatcttttcatctctcttctcttcctccactgaaatattccccacaagaactaaca

SEQ ID NO: 4307 - DNA, 2000 bp, Arabidopsis thaliana
tttttaaaaataaaagaaaatgggggcgagaacaaaggaacatgaatccagcgatttgaagcaatgtacacagcaacttcccactatggcatgcactatcctataaaaccctatacctaatctccacgttcctcatttccagttttggcctaatttcttttcataatatgaccatatatcatattacagaattgatcaatataatacacggtttttatttctaaataccttctaaataaggttttttatcagcctaaaatacgactcatttgatacaaagtcaaacagtatacgatttttcaaaaaaaaaaaaaacaacttaattaacttcaattagacaaccatgtttacttaatttgcaacatatctcattggctaaccacaaacatacataactaattgggatcaataaataattcattgcattctcttttctttcgtttgtcattttttttatatatcatatacttaatgtataactaacaaaatccataacaatcacaataatttcacaaactccataacaatcataataattttattatattaaaagcatatctttattatatagtatgtatttatgtataacttacaatatacataacaatcacaataattttacaagacacacgtatcaatctcaataatagcttaaaaatgaaatggaaaaaaatatatactagaagtcggttataaaggacaaactaagctataaaaaatatctcaaatccaaagataaacaaaaattattatttgtactactatacccttagcaaatgtgctctctcaaactcactgattgaatgaaccaacctttgaggtcggcaacgcaatatggatgaagaacaaatcgccttcagcgtcacattcatcaagacctacattgtaatacgacggacgaactaattgtaagatgctgatcatatcatcaatttaagagctaaagattactaatataacaaatctgtttacgttagataactaaaccattcaaaaggaaaataatattaactagttgaacatgcttgttagtgacaaaacatgttcacaagattttgtttgaccaatattgaactatgcaagatggtcatttcctataacaattctttaaagaatactatatagatataaacagttctatctaaatatataactaggttcgattcatttcatctttgatgtcatcattcaacgctttgataattcttttatacaaccaaattaaactaatcaaccatacttattctataccgacgaatcgttttgctacacacataagcagccttaactactcacaagttacaataatccaatcatgcttagtaccaacaagtttggttctcctcctcatcctccggcgaatcttgaaaaacaattattatttgccgtaagactaaaagaccacgcaacgcaacacaactgtcacgggatcatcggtcctcctttttcttcaatcccaaaacattaaaaatgaaaaaacaaaagacgagaatatggtccacctcatcgtcgcatcttttgacacaagtcgcaaaactagtggcctcttctcgtcttaattattaaaaccaaaacaaaacataaaagccatataaaaatcactttaatctccttaattaatcacacttttaattaagccaaaagtaagacaatgattagtgctactaatcttcggtggcttacaagattacgagaacgactcgtaaagaaaaaacgcgtcttccttgtttctttccttctttatcacaacgattatttcctttttcttaacaaatcaaaatcaaacaatatttcacaaattaaattcctttatatatttcctttctttaatctctcttaaagaaaaggaacaagaagaaggtacttttgtcggccggcgcaaaaaccagatctcttcttcacgagtaaaaaccttctctagatcagtttattaagcaaccacccttttgctctgtttctaacaaaccagaagaagaaaaaagtttcaatttttcttgaag

SEQ ID NO: 4308 - DNA, 945 bp, Arabidopsis thaliana
gttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatatatcttactaataataaatagagataaaaaaattctatttagggaaataaatcagtatcgataaacaaaaacagaaagaagaagcaggggcatcctttggatattggagttgcacgaaaaagaagaagcaaaaacaaaatgcaactatatgtttagattgtttgagctggaccaagtgaaaatgcacctcttgaattatggtttaggttaggtaacaaaaaaccctaaattgactcattcgataagaacagagatgcaatcataaatatgagtgcaaagcacgttaccggaagctgtgatggccttgtttgcgtctaccgtatagaaagattgatgtgtatcatcaatcccgccactagatggtatcgatctcttcctcagcctaagattcaacaaattaaccgccttagacgaaatctacacgagagaaagtttcactttttaattcttttgcttaatcaatttgcttaatcaatttgctcatatatgtttacttaaatttttgatgtttttgtagtattatttcactattattgtgcctaattaattgtttttgtttttacaaactctctcatagcttattattctgcatcaaactatccaggattcggtaaagacactacgatcctcatagaagagatctggaattctagtttcagttgtttatcaattccaataaagtctacacacatagacataggataagattattattaagacctttaaaaaaaa

SEQ ID NO: 4309 - DNA, 453 bp, Arabidopsis thaliana
tatgatatgtgagactttacgtccttctagcaatgaaaattatgcttaaatgattaattctgagtgcattgtgctaacttctaggtttgagacggttgatctagcaactagggtgctggtacctatcattgtgctccaaaaccacaatcgatataatatcatggaaagaggacaaaactacagcataaatattgaagagatagaatctgaggtaaaaacttcttgcgttagatgattgatgttcaagaaatactagaacttgttatcttttgttttgttttctgaatggtgttttcatccttatgagttaatatgattagtaaaaaagacatgttttccaagtttactgctatcagaaagttagcacccataatattttccaaagtacactcaaggatttgactctattggtttacacatactaactgcccggggtctttgcaggtaaagaaa

SEQ ID NO: 4310 - DNA, 2000 bp, Arabidopsis thaliana
ttgattgataattttctcaaattttggaattgctattattttatgaaatcgttatctaagttaaatgatcagtccattacatcactattctgttttcttcttcttctttcgtattttctacattaaaccaaaatatcaaccaaatactgaaccagtgtcaatactcactagtccattaaattatcatttgctttgcaggtagaaatatcgtatttataaatgaataattgtaatacttttagtagtttgagacctattccgacaaagtgtggaagatgatgtgagctagaaatttctcttattaggtcagaagttttgtaaattcgccactgagaaatttgcaaatcactttcccttttacattttctctacgccgcagataaataaatgttttaaaaaatagacgacgacagaaaaaaaatgttttaaaaactatactcctatatatacgtacgagaaagggaaaggcgcacgcatagagaagaacctttgaatatggcgaagggccaataagtcaataacggcttttgtagttccaagagattgcaaatacttatgttgtgtcgtaggtacgtagagtcaaacactcaatatataataagttaagagtcttttttgtactatatcaattctgatttatacctatggagacacatgcgtttgtggaagacgacgaggacatgactcatgaacaccacgttcctctctagttatttattgataatcattttacatttccaaagtgattggaggaatgtgaagtacattgacgcaagttttacacagttaggcaatcgtggatattgctcatgtatgcccctctttacgaacatcgttaacatttaataacaaacgtttaaagttgagacataaaacagtgatttcaaatttgtattagggtggtcttattgtgtgtctagctactagctagagaatactagaagaagaatacgtagcaagatacgcacaacatttggtcctctcttttttttactttcttttaacacattgtcctcttatgatttgcttattgatttcagtatctttttgtatcaataattccctccaaatgattaaaccctaaaaaaatgtgattcattcaccacccgaagattagcatcatcaagtaacacacaataactaccaataacctagttttcatttttctatactaaaatcctaaacatcccataaaaatacaaacaactctgaaccaataatttcctctaatccacgtgcaccccatcgtctcctgacgtaagatttgtctataacttatcaaatcccaaattcagctttgttttcattatatagtacgtactcttataaaaaagagaagagtacacatctttaatactttaacttaaaagaagaaagtaatactaatataagaggagtctgagtcagcgacaagtgttcgcggagaaacggaaacgctctctttctctctcttcccccaacgccaatacctttggaatccctccctaactctgtcctgtcctttcgtcctcactttctctctttttacattttctacacaccaataaaattgaaaccagcaacttataaatcaactcaagtttgaattaatgatcgaaaaactagtttatttgtgtcaatatgacccattctttattcacataagtattttaacttttcaaaatgttatctcaatctcctttgagtttctgtcttccccataataaatttcaaataattaatacacatggttttttaattagaaataatggaaaagaaaggacaaaggaataaaaaagaaacacaagttggcacactctctttattattcactcccctctataaatctcatactatcttctctcatcttcttgaaacttgttttctctttcccttcttcaatcaaaacctatttgcatgctctcaaacccgaattaaatcgacacttttcagtttttgttttaacaagtagagtttcccaaaatattggatatatttctttttcaaatttcggaaaagaa

SEQ ID NO: 4311 - DNA, 2000 bp, Arabidopsis thaliana
gaattaattattttcttgaaaaggtcaaaaaggaaaacgtgggatatatagttgcagcttattcatcaaacagttacaagttttttattaaaaattagcaaaaacaaaacaaaaaaaacaacacataacttttacaatttataatataaataaataaacttttgggttgaaaagttaatttaacattaatatttaaatattttgaattgcaaaatatttgagaattaataaaactttttttttgcatttattggaaattaaatataaccttaaactaatactttagatcattttcatatttagtcaaaattattcaacaaacttttattacaatgattcattttaattgtatcaaacaaaatttccatagagtcaaacttataatttatatgtttaaaagctgtatttttttttactttggttttaaatatgatatttgtgtgtaattaatttttcttgtttgtcaagtattattaagatagagagatattatttcatatcatcaaatgtaaatgtcttgttaatccaattatccaaagatcagtgacatatccgatatatctattctatttaaaggaaaaaaacatttagtgattgttttattataacatttaaggaaaatgtacactattcagaactttcctattttcctaaaacacccttttccttggacttttaaatccattatatttagtcttctgggtttggagcccaagaaataaaacgtagaaggaaacagagggaagtaaatgattcatatcagcttaccaaaatttgtatcaagctttaaaaattcgtctctctataaatctgaaacatattgaacattaacctccacatctcactcaaaaccacttctctatactccaggttcatttcttcttctttaatctttaaagtttggtttaaagtttttctgatacatttagtttaatcatttttcgttcttatgatagttaacgaaacaagtttttgtgtttatttttctgacaaaaaagcagaaaaataagatgaatcaaacaacatcttgttctttttcttagaaaattcttgcctgaaaaatctctggttagtaaaaaaacaccaaaacgtttttatattctaaagaatcagtcgtgatttgtattctattttatcgctttttaatttttttagaggaattttctcatagagaattttccagctgtgttgcagaaaacaaaagaatgtcacgtccaacattttctttaatttagtaaacattttcggaaaaattcttttgcattatgaaccattttctcccgataataaaactccaaataaggaatccactatagagacttttgactgttcaagaaactcaaaatatatgtttagttttccctttacaatcataatttcttttaatgtactgtatgacgtgtaccaggattcttattcttgtctttattttacatgtctgcatccaacttttttatatgtcacacacttggaattaaatttgacgaagatgttttgtaacttgtatggattcctaaacaccattcctttaaaatggatggtggataggaaacgtttaaccaaaaaactaatgaatttgatggataagattgttctttaaacatcaatttcattttgtaaaacaatgtcctatgtcggctagaaaatatattagtcaaaaacgaattttggtttcgccatgtgtacatgtagaggtcaagtacgtgaatataataacaacctctagctcttagctctactgctctaggcttgtttcgtaaaaccttggaagcttgaaggctaaaagcgtaaaagaaaagtcatgttttcaataaatttcttgacttttagttataatatcttgacctttgttataatatctaacccatagtttttctttatatataatgtgaatatggaaaacacaagacttcatcttatattcatcaatcttattcttattttctctctgcagttttcaaaaactttctcactgttatctgcgtctcttttttggatca

SEQ ID NO: 4312 - DNA, 772 bp, Arabidopsis thaliana
gtttatgtatttcaccctcattaatcattattatgtctctcgctcatcatatacatgcatgattttttttttttttttaacaaattcaatcaattcacaaatgagctaaatcacaatagctccagcgaaaatgcatgatttttaaaatgcttctttcaatgatatagttttattgtaatggaaaaatatttagcaaatagattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaa

SEQ ID NO: 4313 - DNA, 283 bp, Arabidopsis thaliana
ggcggatacgccgacggttaaaaccctagagagtgagagtttatggggaagacgaaccaatttggatgagaaaatcgaaagcaattttcgtaattttgttttaatggacttggatttgaattgggctttcaaaataaatatgggctttaaactaaaaacgacgccggatacattctcggtccattattcgccacgtgtttaatttctagatgctcttgttcttattcttctcgtcttctccataagccaaattgagtttatgattttggtttctgaatcacca

SEQ ID NO: 4314 - DNA, 919 bp, Arabidopsis thaliana
cttcttcctcgattgatccccaaatcgatctttgattcgttaatcagtgtgtgttctagggattctgagaaagacaatcagaaatgaaatgaaatgaaaaatcttttttttggtgactttttttttaaaatgttgtaataatgaactgggctttaaaaggcccatattaaaatagtaccgggtcaaaactcgaaccggatccaaaaccggaggctaaaactcgaccaagcaatgatgagcttggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcaccatgtatcggcttgtctccaacgttgcttccaaagctaggtagatctattcgactttttggttttctttgtgtatatgattccaatgctgctttattttctgtgaatttgtttctgattggatcctcgaaatcggaaagttgcgagaaactgttgggaattgaatcggattttgatcggattgaattgaatatttctctgccattggagagtttagcatcttctattttctttgtatttctggaagttgcttcatttattgatgggatttatttttctttgtttcaacaggattgccagaaagtgtacaagccaggttcgtgttcttcattttgtatctaatttgtggtttagccgtttgtgggtatgtattgatgtgaatttgtgtattgttagattggaagcaggctcaattctactaggaattatgcagcaaaagacataaggttcggtgttgaagctcgggctttaatgcttaggggtgttgaggatcttgctgatgcagttaaagtcact

SEQ ID NO: 4315 - DNA, 2000 bp, Arabidopsis thaliana
atttggttttatttcagttaagttttcggttcacaaccaatatgttggagtgttactaatcagatagacgggtaaaataaattgtttgcacaacctattcatatagttaaaataagcgaatagagagataattgaaactacagtgaaaattaacaacaaatggaacatacgtccaagtagttgagacttgaggagtagaaagacaacgtaaggagttgacaaacatgtgagccatttgagactaattcacagacaactaaaatccaagagttatactagtaaatgctttggttattttaatatattttcaagtcgtctgcccgttgaaaactggagaaaatgtatatagagtactattcagctcgaagacaaaaatgtagtgactaaaattaaaatgcttaattggtcggataaacaatccaaaataaatgggaaatgagttttgagttgcgatcgtatcttgcattacaagaagcaaattttagggttaaagtttctgtcacataactccgttacacaattcgcttaattttggatatttgacagaaactaattaatatgtaaactttaatatatatattggattttaggcaatttaacaactaattagtggcggacaaatactgattattttccctttatatatatatatatatataattgaatgcttctatatttgttattttgttgtcacaatgtttttttttttaaaaaattaaatttgatatccttcagtccatcactagttaacaacattgccaaaatatactatcttttcgtcgaaaaaaaaactcaccatacaaactaagtgatttttcagtagtttgtgatcaatgcaaaaatgataaaattaatttaatgtttacaaagctgatgttgggtcgaaagacttggacgtcaaggataacatttggttctaaaatatatggacgtgaaagatagcataccatctttgggactgttcggataagaatgtgtgtgcattagttttggaaagtgtttggccactcggatctttttgtgataatctccagactatgaatattgcggaaatataatccatgatcagagaatatttggcgatgcttgatccatgaccgtaattggagccggatatgttatgatttgatctacaactattattacgctagataagccaattaattatggtaggtgatcgtgaatataacttcactgtccgaaaaagaatagtgtatatgttgccctgaaccatctatctcattaggtgctatgaactagtgagttttaagtatagagggtgcatataagtcgtttttccatcttaaatcaaagacatttcttagtatcttctagatatttcattcttttagtaccatataaattagggatttggacaattcacaattatttattttaaaccaaacaaaataattgttctccgataatcagatgtgacttatgtgatatagtacatataaatatacacactgtttaaatttgtctacccaatcggaatcatagaaactttattgtttacccaaacaaaacggtactgaatatcggaactttttttattaaaaaaaaactgtgagagagaaattgaatcaacgtccaagtcacttgatgcaagaaaaaagcgaaaccaattaaattcccgtaaaaacagaacacaaaagaacaggagagttaatgttctaactgacacgtgtccctaccttgccatacactcacacaattaaaatttctaactctgtctcttatccgaaaaataatcatctccaagtgtaataagaaaatcaaaataaaactctcatttcttcttcttcctcgcctataaatacaactccattctctcatctcctacatcacaaaacaaaaacctcacttaaaaaaaaaaaacagaagacagaaaaaaacaaaaaaaaaaagaaaaagaaaaataaacaaattttcttttcttttttttcctctaaagtttctattttgtctattcgtgtttttttttttacttcctgata

SEQ ID NO: 4316 - DNA, 583 bp, Arabidopsis thaliana
tcacgatcatgatctcacaatctggcagagtctttccctgtcaggggtatctaacggtctcaaaatgatctctctgccctttttgttaatttttttggaaagagggcttggaaatgttctatctttttttttttttttttttcttcttctttggtttcggagacagcaatggctgaaacaaaataggaaaagaacagtgttttgaattggttaataaaacttgacatcctttagcacaattttcagattctcaacatatcaagttccatgatttttctatttctttatcaaactgtatattcgatttccttgatgcagcaactagaaaatgttgaacctaactagtttttggaacccaacacaaatagtaaccctctttctgagccagaggcttgcctagttaatgttacaaaagaaaacgaagcgacatcttatgctgatgtgtcaggatattattggttagactacgtaattccacggagcttgtgttcttaaatctgctgcttcgcaggatcgcgagagagaaaaggatacaattttacagaagaaagtgaaaagaaagagagaaaggggaagaagaaaa

SEQ ID NO: 4317 - DNA, 2000 bp, Arabidopsis thaliana
tccacacacaatgttagcaaaagttagctgttggtaattactttacacatgttcgaatagttggtacgtttattattacaactgcttagtgaattactctatgttaaatgattatttttcctaatttcctatatatcctattcaatatctctttcagaacatatttttttaaagtatatttactgactgaatttttttattatggaaaatattgaatcctatacaaatgtttcgtaaagctcaattcatgatctcgtcattgattatcaagtcttttatattttcttttgaacagagcctgaaatattataattttcatctgtcaacaacatcatattttaagaacaaagttttatatgtaaaagaagcagaacaaaacgtacaattttgtattttgtaagaaaaaacaaacgtcaaaataagaagaatctctttcgttttggctggcataaaccacgtggcatttctagagtagcccaccgttgcgttgcgcaataaatcttatctctttatcagatgcctttggtcaaacggtcagatatcaaatcttaatttaaaacttgtcgtaagaatcaaatattaacacaataatgtaactataaagttactactagtacttaattcacttatttaaacctaagctagcacgcgagcagcatgtgattattgcgtacataatgcacttccctaaccgacaaattactaaatcaaaatcttcttcttttttaatgcatcattatttcataacaataatttcaccacaatcaacgtaaatgtttgatcatcaatcagaaaatacgcgttagaatattttataagaaaaattatatggtttatgaaaggaaattttacagctcattttgataaataaagcatataagagaaaatatttcggtggaaaataaaaagtatataaaaaattgtcaaccatatgggagccattcttttctggctgtcatgcagtactattatcattatatccgttggctttgtttttcttttctttttcaagtgtcaacttagtatttattttgcttaaatataataaattaatggtcaccgacgataaaaagaagattaaaactctctaatgaaggataaggtatctataaatccagtggtttaattagtaatatattaaaaagaaaagtatgaagaatgttattcgaatatatgatactaaagtgataaatgattgtcttagcaaatttaaatcatactatttaggttatatgcgctttactatttcttttgattaattaactaactacttttttaaaattaagtaaatagcttcaagtagaagaatgtgagactacatttacattgatcataatcttagtgatttcatgcaaagactaaagctttgaatggttatagcagtccaaacgaacaaaaccgtctacgaaccggattgctttttatttattatttatgaactattgtccgtaataatgagaatccaaaaaaataaaagaaaatcactgcagcctaattgaagactgtcaattaagtctgcagccgtttgttgtccgctttaaaaatactatatactggacagctgacggattagcccacactaatcgcaacatcaattttaaacctaataaagttatatgtaattatacccttaaatttatttattatctttttttttttttgacacaaaatttatttattcttttttctcatatttaggcaaatttataggcgtattgtgcggctttatttctggtaaaataatagtcaaaaagtaataataataaataattaaggagcaacctaagaattttgtagccgttctcttatgtctatatcactctctggctctcttctctttcttctatagcttctagtttctcccacttctcacttcctttttcccgaatcttgataatgtaaattcacaacaaatctgtttaaaaacaaccaatcaaaacccaacattgcttctcaacaaaaaagcaaagcaaaagattttgcgagagaaaaaaaagaaa

SEQ ID NO: 4318 - DNA, 716 bp, Arabidopsis thaliana
aaactatatatgaaaagcttaggattttagttcttatatgatagtatttatatgaaaatataagtgtatccggatcgaccgattcagattgggcaaacccttaaaggagaagtagataaatgattgatcgtctggtcgattaccattataaatctcatgaaatacgtatgtctttcctctttttcgttgaaggactaacttttttcaagagagatttacccgttcgattgctactggtcttagtttcttcttactcgaactcgttattctcttcttggttctttgcttgttcccatctatagagtgtgtgcttcagatagtttcatagacctattaaaagataatatatatttgcaatgcatatgctctaggatcttaaattcaaatcaaaactaaaaatacaaaaaaagaaaagaaaaaacaaaaaaaagaagacataaacctagttgtttaaaccactaaaatacaaacgcataaacttactacacatgaaaatgaaacgactacatacgactgactactttgcatatatatatttgtgaattactcttcactttttctctatatataataacaacttgaagacaaagacaaaataataaaataaccttatctcttctctatatattagttcttgagatctctccaacaactctactttgtctttactcaagtatttcactaagaaagatagaatcacaaaaaggaaagagaaa

SEQ ID NO: 4319 - DNA, 931 bp, Arabidopsis thaliana
caggctccacattgtcataacgttcggtttagttcggttttagcaaaaagagagaagagaaagaactgggttatgcttctgggatttgcaggagctagagttggtttaggtttagtttgatggctgacacttttaaaagatgagtaacagtattagtaggttgcgttggatggtctttgctttagtcgaaccggtagctttgcatttgtaatctgtacacttgatagtgttaacaccttttataacttgtattactatagacttcataaaagtttccaatctctataatttttttgtttggtaggaaggtggggagacaaagacaattagaactagcagaacaagttttggctattgaagcagaattataaaattttggatagtcacttagcatttgaccggtccacatattaccggtggagcggtcaattagaactagcagaacaagttttggcctttgaagcagaattataaaatttggatagtcacttagcatttgtggttcatctaatatttaattactccattttatctcttaatctaataaatttatcctcacaaaataagtatacaagtttttaataacattatattttagtataatttttctttgtcaaaccacaagttaattaaatactaactccatgattggttactagaaaacaattacgaatgatatattttagtatatttttttcaatcatgaattaaataataaaatagtttgagttaaattaattattgaacaatattcataaaacttttggggtgagtaaagaaataagatggattgaaaaaaggccacgtggttgtcacaatgcttttcaaaaatcttatccaagcataagtctccttggtacctctcctctccaatggatcatccgtctctaacaatgaccaaactccgaaattataagaagtaaagacaacc

SEQ ID NO: 4320 - DNA, 1914 bp, Arabidopsis thaliana
agagaaagaggtacagatttgagtgtttctcaaaaaccgttgaacttcctctttgtttcagaatctcagctagctatatcagtttcatctgcaatattatagttaaagttcatgcatctcataataagtccataactagctttcatcgaatctcatgtttcttaaattttcgattctgatagttgctcattcgacttacagcgagtcaaagagcttttaaaagtttgtttcgcagtttccatgtttcatcttttttgagctttgaaagcgttgttgctcgtctgagctcttacaagttcacaaatttgcttttgcagtccttcttaagttataaccctgattcaaatcttatgggaagaatgggaggagaaaaagcgacgacggatgttggtggcggataattctgaacctccacgagtagtctccgaagttgcaaaagcaacaatatatatatttacatggttatatcatctctgccacttcttttgaatatgatcttgtttcttcaactcaattttttgctctgtttccttctctgttctttcacatgtcagagatacaaatcctctaagtgtatataatactttatatgtatgtatcagaacctcactgcaggatgcttcagttcatgattcttattaaaacagagggttctctagacactaattagcagcagatttgtaattgtggctgtggttttctctaattgactccacaatcatcgcatgtatacgaccactccttaacatatatatttacctaaaaagataatactatattctaatcaccccacgctggcgatgcttttaaagttcaattcattacatactctatagtctatgttatcgttattgaaatattcagatcaccatgccctacgaaatcaacactttaaattaaaatgttaataatcaacgtataaaatttattctgaccgttaataaactgttaataaagtatcatagagagccattctcactttgaaaacgttttactatgagtatatggtgtcgaatggttaggctatactaaccaaaacaaatggaaagtatacacatagtaatgcaattgcaaatatatattttaggctataataagcaaacgttttcaacccaacttttgctctgctttgttctcattctctgttatttcacatgtcagagtagatacaaatcctctagtgtatatatactctatgtgtatgtatcagaatactgctgtcactgtaggacgtttttgttcatggattcttagtaaaaccgagggttctctaaacactagttagtagcagttgtagctgtattcttttttaaagggctttgttttatctgtcacattgcaaacaatgacgatgagacaaccctaatggagaacctgctggagcacatttggttgaaaccctaaatcctggaagaacacttaaactggagaagatccagcagcagatcgatggctttgtcgttttcaatgaggttgcttctaacaacttgtagaaagatattacaatttaataaaggccaaagataacaccttcgtcacgtacataggatccgcacaagtggaagataattcaaatagtctacgtttaataaagattagagtaatggttggacaaagtaccgtatagttaggatcaaattatttaacaaagtattaattagtattgttaatgaattaaactcggaaagtatcgattgacatggtgagacatagctgtctctcagttgacatcggcaaaagaatatttttcaagtggcctagtgataatttaaaatatatggatatatctataaactattttacttagatcatcaatgtaaattgtgaaaggaaaacaaattcatttttcttgataataacattgagatcactagagaagagagattgaggtttgattaatttagtgaattcagc

SEQ ID NO: 4321 - DNA, 2000 bp, Arabidopsis thaliana
ttctgcaaaaccctaattatatttcttcgaaaccctagtttcttttttgctgttaaagtggaaaattacctttgatcggaaatctacgggaacgtaaacagccttgaagaagttctcgaagagagccttgtatttgggatcaatcggtagtgatttctcaatccagaggccattcaccgccctcatctttgggccgccactagcgctgctgtcggcgtagacgatggatgatagttctcggaagacggatttgagctcatcgattgaagaagatctgaggaaggagaggatttcaccggcgactaagccacctccggaaccagcggcgtgcatggtgatcgcagagtttattgacgccggcgagaagatgacgttagattccgactcagaagataagacgtgcctcccaaggatcatcgcgacgtcgttttgcttcttcatagcctttttcacattcatctttggtctctccaactagatagagaacttgcaaaagggtggaggattatgcatggtctatggagggacagttatatatagtgaacaaatccattaagaaatttttaattattattagggtttcttggaaaactagtcactttgcaatccaggtgtataaatcaaacacttaaaaatgactactttgcaaattgtaaatagtaatatgactactttcccaaatatgtttgaaaaaattaaaatgattacttttcacttatctcaaattatttttacaatggaatataaatagatttttctatactaaacctctgtaaattaatactcgataagttccacttcaaaaaacgaaccaaaggtcatatttcatccatgcatgttcgaacatgcaaagagaacttactaataatgtttggtcccaaattcaagtattctctggttctctttgcatggatgaaagaagatggccatatttttataggaatgttcagaaggagaattcacaatgtggagaagatagtgctactggtttatattgaagtcaggttaaggtttatgatagtttcaaggacattgatgcggactaattggcatcagatagtcgtgcttccaagactaatatcaggcgtaatgggttttactaatacgattatgaaacagcctcaagaaaaaaggcaaaaaaatcgtattggagcaaaaaagtcgaagaaatatcacgaatatgtgttttcgttagcgaataaggcgttttcgtccaaaacgcatcgtgaatcttatttttcgtatttttttcagaaaatggctcacatatctgcttgtgtaataattttggttctgtagtcttgtataactttaacactttaatttcgatataatggaatgattttaaaaggaaaaaaaaataataaaaaagaagtaaataaatcgatttttattaaattagaaaacaatttaattttggattgaaaaaaattaacgtactagttcaaaacgccaagttaatatctcggatagtcctactttctcatgattcagttctttatagaccatctaaatcaatccgtctatggatctaaaatcgttcttgaaactaacatgatgaaacggtccctagataggttggccgaggcaaagaagaagaagtcagctcttaactctaaaaaccaaaaggaaaaaaagaagtcagaccttactcgttttgtaaagatttagtcagcgaagaagtcgactagtgttcgagtggggaaacacgttgtcaactcttaagtctaaatctttgaccccaaaaaagagagcaagttgtccactataattctgtcttcttatgcaactttcatttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgatt

SEQ ID NO: 4322 - DNA, 2000 bp, Arabidopsis thaliana
aagtataaaaattcaaataaacatcaaacccatggtctgacctaattaaacaaataaagttaggcgatttatcaaacctcccacatgtttagactagctttagaatagccctagcttgggttaattttgttgaaaactagaatccactagccctagcttgggttaattacgttgaatactacagcttgatcagcattgtttctagattaccttttttttttttttttcaattgtacataggatttacttatattttcgaatggatacatgaaacaagaatacttcatcatatatgtttatattttttaaaaaatcagattttatagacaattctattttgactattcaggatattattaaatacagttttcattttctttatctatcttgtttttattttttgactgaaggacttgtcagtaacaaaagtaaaacaacaggtttgttatatcttgtttttttttgtctcccccaaatgattttcagaaataaaaatatttgtgagtggcactcatacgtaattaagaggcagggaatggggcataactggcagtaagaaacaaaagaagaaaaatagtaaaagtcaaaagtcgacccatcagtcactctctaacgcgttagtcaatgggaaccggcaaatggagaccgagacgccactcgccgaaccggcaattatgggtaaccgccaccggtttacttctctaaagttctgactttccttaattattgcaacacgaattttgaaatggccaattaatacatgctctgttcggttttgtttgtactagtcaactattagcgaccgaattattgactattcaatagttcaacgttaaattattaaggacaattcaaaactattcctttcatattcaacatttttatttagagacaaaatcaccaatccataatttaatttatttatttattaatcatttaagcggttcgaaaactatatcactaaaatcaattggtaaaccaataaattacaaaacgatcatgatttactagagcttctcgtttttgaggttgaagactgttggtctcccaaaaaaaaaaaatcaatttaccccaaaactatttttattttgcattaattaattattatcataaaactttattaacaccataaattgcatttggtgcttcaaaaaataaaatagtatttatttacttaattccttaccaaatattttatatccaagttgtggaggtcataaaattggcccaacaagtacaaattaggaaacccactaatatttaaagcccaataggtccactcaattttgcaatttcttaaaacgtgttgttaacaagaacacattttatggtccagtggtcaccgccaccaacttctcgacttcgagagagacaagagtaatccaacgatctggttgatagtggtaacactgttccaatgagcattttttggcatatccctcaatatatctttattgggaacatctagcgttttgttctttcttagtcggcttgattttttctatgaacaatctctagatgcaaaatttgtgtagtgcttggactcttcactcggctcattgattcttacacttgttgcatatttcacgacaatgaaccttagtaacggtcatcttgattactatttttggcttttggtctgtcttggctttgttaatttaccggtttggctagaaaggtttcgtaagatttgtttgatgtcttctttaaaacttgaagtctctaacttgtttgataacttttgttgtgttaggggaaaagtgtgctatggctcaaaatttgcttaatgcttaagtctaatcagattaataaagtttgtgtggttttatattccctctttttttttataacattttttaaagaatgtggttctgtggtgagtgaccactcacaccaccaacaacaacttggtcagtgggaggatcattttatttgatccttcgttgagaagcttaaatcagctttacgtgaaaattgtcatgttgaggagaaagtaaaaa

SEQ ID NO: 4323 - DNA, 2000 bp, Arabidopsis thaliana
gctacaaattcatagtaatggttcacaaaaatttatagaaatttcagtacttttgttatagatataaattttgaaacgacaaaatgttttgctactttctaccgcaatactgttatctaattgtaattaattatttctaactttgacctaagttataactcaacgacgatactatagtacaagcttattactaaactacaaatttaaacaggggtgtgactctagctagctagtttataataaatgagacgcaatgatggatatgcagctacaagtgggttcataaaatattacatatccactttggttgtggaaactggaaagttatgtaaattttggccaaccaaaggaagcaaagactttgcttctcaactcttcgagtacacttccgagtaagcttccaacatgggcacgtagtggaatatgttgcgcaatcctcttgatgtcataaacataatggacaaaaataatttaaaatttacgtacacatgtttcttaaaactccaaattttatccggaaaaatgaatgttttgaaaagtctaagaacaagtgcgatattatgtgacaaacagaacaaatacaagaacaagagttagatcgtaagtataagttacattttccatcatttggttgtggtttggatgaaatgttctaccgagcataatggcagcgcttgtctaaaggtttcccccaaaatccaaatatcattttaaatcgagagggatcggagtatcatgatcacagttgaatactccttcttttatcaattagacctcgagtaaattataaattccaccatccataagaaggtgataccatctttgggatcgatattatcgacctttagaatccgtttcaagtttggcatatatgatatatagttaaattccaaagtatatttgcaacggaccatctaatgaaatcctcgtttatactatgaagaagttggaaacattacttaacatatgtatgtagacgagagcaataaatttcatcaaagcctacttttctattttggagacaaatttggctgataatctattaatttggcctttgaagtgtttctactttctacgtataagcaaatttcttttaacctccctaaactttctggaagacttaaagtaactaatatcccattcctccttctttggatatttacaaaaatttctttagttcgtctaatttaggattctagacttgtatttgaacaaacccgtagataatttattatttaggatttgaatattgatccgaagccaccccctataaatgatgagtcttgcatgagaactagttcacattgactttgatcagcttggtacgtacctaataacttaaaaagcttgctaattaccttataacttacatccattgaagagataaagggagattgatggcggaatttagaccgatattttctccaatagatcattataaaccggattacatttttgctgtacataggctgcgctaaacaccccaaatgcgcacaacgttatcaataaaaatgaaaaagtaagggcatgagatgattagtttagattatttacatgcactaattctcccactattcaaaacttatgagtatacatttaacatttactaggttttggtttttatttgaatgtttgtatgacgtttacaaggaaaagttcgtatgacttggtataatatatggcattttaattctagataaaatcacatgctcacatgggtaataacaaatcatttattttgccaagtgactgaactatctgacaaaaacctaatattacaaaaacctcaaaatttatcccactatattatcttatttatagtggcattcccactttcttaattatgcatgcatctccgaggcgcacccttgttaaggcaaatatctattttttaaaaatacaccttgtttttggtgtataaatacaagctaaaatcatcatagcaatacactatcaatctacgatcatatatctttcatttcatcatcatggaccacaaa

SEQ ID NO: 4324 - DNA, 1765 bp, Arabidopsis thaliana
tctcttgagactttgtactcattctatagataaagatgggatttattacaaaaacaacaagaaactttgttacttgtggaaattcaaaattatccgaactagcttcacaaaatatgctcaagagtttcaatgtatttttttttgttctgtaattgtatgactccgtttgaagcatcaagattatggttataggtagtgatgctaaaactctctgttgttacagtgaccactaaaaacaccaacaaaaaaaacttaggtaacgtgtcgtctaaaaacttctaggttcaatttctttagatagtactatcaataaataaaataaatatgtacaaaggctttaaacaatgatgtttttcaaagatgattggtagatactaattagagcttcaatataaaagaacacatgcgattctgacattctgtggtctaacatggtttcttctagagtcaaaaccatacaattaaaagttaggaaagtaatagcaatgtggtttcaaatatatactcattactctttagattcatgtatggtgaaggaaacattataataaaatcaaagatcacagttttgtaggtccctcatattaatcaacatcttaaggcgttatacatatcttctttttgtaaatatttgactaattaaaatatctaattagagtattagactaatctcatcaaatatccgactacttgtgtcagttcaaaacacagtgattacgttagattttgtgctcttttgtttataaacaaagctaatttaagaaatatatgatctatttgcctccttggtcttaattttatactttcttggaataaaacacatttattaaaataatttttaggttcctagattcatgtcatgtggcttgatagtttccaacaattataccaatattttactcattcatatacaaataaacaagctttattctattcttcagtctcatgatatacgggattttgataaaattcagagtacccattaattattctatgttacagcttgtaataagttaaatttataaaacgtacaagttgaggaaataacaaatgttttcaatattaaatgatttattaatacattagtgaccaaaaaattattaagtgtaagaaaaaaaacacaactcagaaaaaattcaaaagaccgtctaagttcggttcatgtaagaacaagtgggacctctttaagtttctaaatcagagaataaagaagaagaaaaaatctcaaaaccttcctctaaaaccaacggctcctacctttacttacaccctatacatacacttctctttttatcctccatcggcggcttatggcggttttccggcactaatcatctccggcatatataaataaacgtacttcacgtttttttatataacttcaaagtagtttcagatttgtctctatctcttcacttttaagtcttctggttttgtcatcaccagctttttttgttctgtctctgtctttctctttgtgtatttttattctcgtcatcgttgttcttctatgagaggaagatcggaatgtcgaagagaattagaagattctcgtacatcacttcgttggaatttcacaggtcgatgagagatctgagaactgtttcattttgatccaaactcatctctttcaggtattccaaatttttctttctctgttctttctactattacccaaattaaagttttgatttttatttctcactctgtttcttgtttttctaattgcagagtataatggactaagcattttttttctccgaag

SEQ ID NO: 4325 - DNA, 2000 bp, Arabidopsis thaliana
aatacgaaaccaaaatatctcaagcatggacaatgcgtgtgaatgagatgaaacctttgtagtcagatgactcagatgattgatagtataaagtcttctatatgtaattatggattgtggtgtaggttttaatcgttttccaagttatgaaattctaacatcaaaactaggactagaaaaaaaaccaaagccgaagatttattatattgggttcgaaattaaacttgaacccgaagatttactatattggatcctaaattttttaatccaaaaaatctaagtcgaatccgaaaataccggtattttattcgaaaatctaaatttattcgaaatctaaaattttatccaaaaattcaggtatttactcaaaaattcggatatcggttctaaaaggaccctgaaaatttatatccaaaccgattaaaaaccgattggatacaaacttaaaccaaaccgatattttggatttatcccattgaatcttaaacttttatatccaaaaaaatcatatctaatcgggttttacccgaacttaacccaaatgcccacctttaattattcaaaaccaaaaaagaagtgtttgatgctgaggtttgaactcatcagatacacgtaactattttccaatttattttcgtttatgtgcatttcagaatttcaagcataaatatactcttattgtttaaacatttcaaattgcatgtgtgaaataatatcagagttagaatatatgttaatcttctcttctcctagattcagttagatacgtttctatcttcttttaggcaacatctcttgtacaaatagtctctttggcaattcaatacaatcaaccttttacgatatatatatttgttatttcttgtacaaataggatcaaaattgttatttctgaagcaaattttctttagtttggatgtcaattatatcctcgattaatatgtaatcacggaacggattcacgatgcgttattttagaagcaaatttatacttgatagtacgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 4326 - DNA, 1065 bp, Arabidopsis thaliana
gagacaacatgatactctttgatccagtgatgttaagttgttaactaaatttgtattgtcttgttatttaaaagttttatgaacaatctactaaataaagatgagtgtgatacatgtatccacagtggtagtataatttagtttgtacgagtatctagttctatctaattattgatatatgatcatattttctcataacatatttttgttctgtaatttagatgataaattgataaccaatttgtattattacgaagaaaaagaaaacagtttgaactattcattaaaaaaagttattgtttaaaaggtattttattagattaaaatattaaattaattgtaattcacttttggaccacgcatttagcatcacacgtataactttaacaaatcaggtaaaaccaaatttctttaattaggtaaagaaacagaagactgaaagaaaaactagtttggaaacaaaaaatggtatttgcaggaattgtaaggaatttgggatactagaaatgtatggatctaagttagaaaaaatcaacaaaaatttgttgaatattatttataaagttggtatgtttgaggaaattgaaaaagataaaatatatttgaatatatggagagatgatataatgtgttcacggttcattggatatttagcagtgaatgaatcaagagaaagcaaaatagttattttcttctttcccgtcgttttagtatacttttcaagcacgagaacggaatcacaaaaactagtcaaaaaaggcgttaaatcctatagaacaaaaacatataagctatggtttcgaacgggaaccaaaccataatatgcgatgcacttctaatagcaatcaaaaatttgttaatatgtacatatatatttttgttttattaaaaccgtatcatactttatctgcagttaaaccgcacatctttattcggagcctatatatctacactgcctatatatcaaccgaccaaacattcacgaaaacaaaccacataaactagtcaaagaagaatagatgagttacattataaaaaagttcaagtgagagaaagagaggtcca

SEQ ID NO: 4327 - DNA, 2000 bp, Arabidopsis thaliana
tcgatggctgattttgatactttttgattgccactttctgataagttcaataagactttagaaattgatctcttacgttaaattttagttggtacttctttttggtttaattttagttgatacttgatagatataatttcgaattatgtttttttttacaaatatcagatttaattattaaaaaaagaatattagggtttgaaaatatcttatctagatggcccaatttaatatttttgcttgtattaattagtcaaaagaaatttccgacaagcaaggtgaacgtaaaccttaaactaatcaggaaagcaagaattaaagttgcttttcacattaatactaatattgttaaattgttatcgctatcgtgaagaaaataaagtctagggaatctgcctcaaatatggtttccctgttggcaaaaatttaacttgcttccattcaaatgatgaaatgttacgaaaaattagccttttgtctttggagtaatgtttgttaaataatcacgaggcattcattcttaaaataccataacatttatagaggtttgaagtaccataatttgtaaaactaaactagagaaattttgcgaaatcagttgtatgaagactttcttaaaaataacgttatatagactctagaaaaaaactattatatgccatttctatttagtttttttttctaaaaatatatataaatatggtgttgttaacataaaaacagaaaaaaagaaaaatttagaaaattttctcaagaatcattatatctgtgatttatcatataagttcaaatatgatattagaaacaaatagtttacgagtataatagtattgtcaatttttcaatctgaagtaaatatctttttgtaaggaaggggtcaacaaatgatcacaacagagttggcaaaaagttatcaaatcgcatgcacggaagttttacgtgtggtgaaggtaaacttgtattacacttatctataaaaattagtttaggctttgattctaaatcaaatctccgattagaaaaaattgcgtaagcaaatagctggaaaaaattgtatcccatcatacttaagtcacaatgttttgtttttgagatttgtgatgtaatcaatatatgttttacaatgcaagtataataatattaaagtcacattctaagaaaattatgatttgtgtcatacgtatacaaaaacacccgtcacacatcctgacttctgaacgttaaatctgtcgcacacaatcataaaaatttaaaaattcaccagagatgtactgaaaagaatataattaatcacatgatgatatatgcataggagatgaggattattcattttctgaaattccctatatgaaccattataattgtttagtaatcagttcagaaatgctaatcattatatgaaccattataattcccttcatttttatttaagatccacttaacaggatttgttaatatgcacccacatcactaaatacattggtacgcaaccgttgttccatttccattttcacatcgaccagaatgtttactatgcggtaaattgtgtagtatgcagatttttttgtatcatttaattttctaacacttgttaagtcgaaactaattttgtcacaagtaaaagaaataaaaaaggtggaaattattaatcagtagttagatgattagtttcgagttgaaatgaaactcgacttaacaagtgatagcgacgactctagaaacagccaaaatccgccctattgctacctgtcgacccacaaatcgtttactcaaaaatgaataaaaaatttacgataaagcaaacccaaagttatatcttattatatgctaaggagccctcccaaaaaagaacaacaaatcacatttttatataactgttaacataataatctcagcctcatcaacacacatatatagatagccaacatcacacaaacatagagattccaaaaaataaaaataaagaaaacataaatcctctgaggaaaaattccgatgag

SEQ ID NO: 4328 - DNA, 2000 bp, Arabidopsis thaliana
aggtgattttgcacatgcaaatcacaagacatgaacgaacaactcaacagcctccacagatgaccagaataagagcatgatacttctattcaggttaaacgactgtaatgagggcatgaaccaaagttcaggtgtagacatgccatcacctactacgtcacaaaccgtcgagaaacccatacgaaagagttttactccatcttgactcacgatagagcgatgaggccaaatgaaaaaaaaaaatattgaatggatagttgatagttcaatccggagaacttttgagctatataccaataaaagggagtttaatgttgtctagcttaaagggaatttagttttgggacttgaaaagaaaaaatatgttcgacaagattgtaaatttaacatcaaaactttagctcgtaatgtctatctagcttatagggaaatttagttttgggatttaaaaagagtaaaaatgttcgacaaggatttaacactccagaagacattgtacatttcgacaaaaaaaaagaagacattgtacatttttgtctctcttttttctttttctttttttcttggtgaaccccgtaacttgcattaattatcttgtttgtttagttttttttcacaaagctgtataaggcgtgactggtactctttcggcatatttttgattgatttcgagagtttcttttggtctcggcatttagagtaaaatctgatttgggatgatttttttgaagaacactaatgtagtagagtcaaagcttacatatttttagtagttggaaaattatttgaacatctttaatatgaatgcaagttcccgtctgcaagcctctttatttgcctttgttttcatttttggtttgaatacaagcaaatgtcaaatatggaacatattgatatctgtactttgtttttaatatcaattgggacaaacaaaaccaaatagtcgaccgtgcatttaaaggatttttagaaatatttggctcctttgcacatttccacattacctcatccatttttgctccgtgcatatattcattatattacttttgagtaactttctcgtgccttctccgaattccgtcatgtatttctcatattatttcctagtgattctcaacagccatgcaatccaaattacctcagaaactttcctttgatatgatccgatccatatcaagccaaatagacctagtttgacccctattactatgtaagaagctccagacaatttttaacctagtatttgtttacgctttttcttctaagttttgtctaagtgtttaagagggacttacaagacttcaactacatttgtgatgacgatcttatcatttcatccagcttagtaatataatgttatgctcgaaacgtgtttgataaaggggttagaccaaatttcaaaaacgttttttcttacttaaccagtatgaattagtggactactaagtgacattgttttcaatgctctagttagcaaatcaaagtttagctaattaagtgatcaatgaagttatttgtcatgaaagtggattaatcttgtttgagcgttgcaagattatataacactacgttgttgcttaatgaatgtcttagcatgaaaattattttttctatcttatcttacgaattatcttccccatgatcaattgtttgtttatttcttgatttgcctagtaaaccttctagtttttggttataaatttataagtttcaccctccagggtttgagtcttcttggaaacaaatatcacatccttgtggaaagtttgggtttaggccaaaggccaaaacattccagaaattattccaaattaggcgggtaaagcccttttctactagtatatgttcgatattcttcttatttggaaaaaaaaacatatgtcatattctactatatgttctcattcctattcttcttagttaggcaaaagatctcattgctattcttcttcttatttaggcaaaagatatatatatatatatttatatttatatcaaat

SEQ ID NO: 4329 - DNA, 2000 bp, Arabidopsis thaliana
acctaattggattcagtatatatacatatgatggaatatatagcgagagtcaaagagatagaagaaagctttgtagataggagaagctcagacacattgtgacatgatgagtaaacaagagactaacctaacaaacaatttaaacaaaaaaagaaatcttaaattacggaaattaaggaatatgtagaaattgagatgataatgttatgtaagcaaagtacgcagcttttttgttttcaaatctcgtgatggcttgtgttttatttccttaccattgttaagttgttttagttagaagcagggtttggccttatgacgaggaaaagtatttgtacacgctcagaaaaaatatcaactagttttttaatacatttgaaaaaaaactaatggtacaaaaaaggttattaccgaatcatatcacattttgaatcctttatggattaccgatgaaaaattcaataatccgtcgattttttttttagcgtcacgagaacaatggcttatctttagtaaactactaactaccattgagtttttaatggaattaagtgggttgtaagcagtcgtccattgatttgttctccatgcatagggttagaaaatcatataaaaaatttgggagactaatttattcgataaaattttaattttagtattcatattaaaactaatacttttaaactttttataaatttttatatattattaatattcaaatttttataaatcatggaactataggatccaattttagtaacatcataaacttatacaaaaaatttgtacgttgttgtaaaaaaagtggtacaaaaaaaaaaaaaaaatgagagttgccaaggtggtacctatggtaaagggttaccaatcaaacactagtgtttgttttatcgttttcaatatattaacacagaaaaataattataaaagctacattaggatttataagggatttaaaatccctcaagtatcggcagatttatttgataaccttcaattatattattaataagaaaaccttaactaagatttaagtgattaaaaattttaagtactagtcggtctatttaaaacttctaaactattaaccgaaaacacactcgtctatagtatcgtcaaaattctaaacatctgttatcaaataattattattatattttgatttataaaaaatgatgtgtatattttttagacataagaaaatgtcgtgtttgttttataatagcattaaagcgtgatacaatagattgcaaaactgaaacgattaaccaatataattaagatatcgcatcatagtgcgtaaaaaatgaaaataagtcatttatagtattactaatactgtattagtaactaaatgagtttgaaataaaataaatgcacgataatagatgatgggttttttacacgtttttggaattttaaatcgagattagcaattttaatatttttatgttttacgtatggtacagggttaccaatcaaacttcaaacactagtgtttgtcttatcgttttctatatattaacacagaaaattaattatcaaaactaccttagtatttataatgcaaattctttttttttggtttagggatttagattatcctataattgttctaatttattatacgagtccaaatccttaaaagtttaaaatgcaaatggttgacacttaaaaagtcttttttaggggattttctccttttgtttttgtaataatttgcattttcaattttggtataatgaatttgtattttcaatttgaaaatttaataaaataagttatcctttactattttaatgaatacaaaaatttataaaattaaaattaaaagaaaaaatgaaatgatttttaaaagagttgtttttaagattaaaaccaaaaacaaaacctagagacgacctatatataagctttagggttttcttctctctgtacccttaaactccgttaccctaaacctcaagccgtcgtctccaaagttccccctcagagacgaaaaa

SEQ ID NO: 4330 - DNA, 2000 bp, Arabidopsis thaliana
agaaaaccaaaataaagcccaagacatcccacatataaaggctcatacgacacaaaagaagagataagctatagacgtgtcagaccaataataataagctagggacacgtggaacgtccacaaccttcactagtcctggacaaaatattcgttcgatccgctttaactcaatattcgatttgatttgattcgaaaaatccgaatattcgtaagattttggagcaaagcaaatagaaaaatgtagtaatcgtaaaaaccgaagcaaataacaaatactattttttctaaagtcggatattcgcttcgatctatatatatatatatatatatatatcacaatataggttgtgcatttgtatatgttgggatttgggcttgtatttgtatcctttgggcctgtgttttttttgtgacacagtttttattagagaagtggaattttttaaaataaaattgttttattttttatattttatcctaaaattgtcgttttactttccaatccatcaaatataagagcgacatttctgtttcctttcttcgacctttcactatttttatcactcaatttggttacagaatttataaccagaaaattttcagttgctctcaatctcacactcgtaagtcataaggtaagaaatttgaaatctatgttaaataatttatataaaaaaatatttggatgtagcaaagcaaagcggatatccgacaaatatcatacaaaaatccggatattcgtattttcggatatttggaaattttcggatcaaagcaaataataaaattaagtattcgattaaaacgaatcgaataacaaatatcccaaattttccggatattcgcttcgtgcccaggcctaacctccactgcacatgagactcaagcctggtgaatcagaaacgtcgttggaaaatcaccggtcaacgagacttcttttttatcaccaattaaaagttacagaacaaacatcaatctcctaatctcatccgattgcaagaatcacaaaggattcggcaaaaatgggtaaaagaaattagagaaaactgagtagttcaaacttgtctaacaattaaatctcttgcaagaacaacaaaggcatatcttaattgcataggaaacgagctttgacctaaccttagtcgtggagaaattgaaactgtcttaaacacagtagatccaaacgaacctaattgtcgagaacgcacacatcgccggaaaactgttggagccaaaaaaaacagaacccaacggtgaagccaatcaaagcagaaagaaactaaatcatgcgaagagaacacctcttcggaactgaagattctgcctgtcataatgtttcatcatcaagattttaaagctacaaaacaaaaacaaatccgaagaaaccgaattcaaaattgcccaaaaagaaatctaaatcccgatcaacgggagataatagccggaaaaaatccagataacggaaaccggaagaaacccggacggcgattctaaacttacatcggaaaaatctttctctgaaaaatactatagagagaagagagagaccttcctccttttagatctttctttaattaaaaatttaatttttatatttttagcatctaatcagcctcaaaaatataaaatatcttagatttttctcgaataataataacgaatatatatataattcgagctccacttgctccaaatttaaaatcattgacgctgaggagtgtcaaaacgcttgacaaatgatcacacgtgtaagcctatgagtggtggtcgatttgactgatgcactatcaacacatacctaaagatatagagagagaaacgcatatcgttgactctccccctttttcactctcttcatttattcttcccctcatcatcatcatcatcttcttctttaaccaaaaacacaacttacaagaaaactgttgaatctttgtatttatttacatctcctttgacctttaataagaatctgagtggttggtctctgatttgatgag

SEQ ID NO: 4331 - DNA, 2000 bp, Arabidopsis thaliana
cgaacgattacatttttaattgcaacaagttcaatagcttgagacgggtatatttcttataagttgtatacatgtgttcaaataaaatggctcttggtgtcgtgaaaaagagagaagatttaatattatagaatcgaaaagaagacactagggtattttggattagatcaatacagccaaaagttccactttaaattaatgtaattttctggctagccaacctttcgagaaaacgaattgactatcgtctacgtgatcaagtttaaccctttatattttaccatttaaaaatatagtaagtagaaattaattgattaacaaatcaatagccaaccaagcgaaagcacttactatttcttaaataagttttgttggggtttattatgtcaggtgattaaaaaacaaccgatggttgaaattgaccgacggctccaagtgtgtgacactgccccgccaacttgtctaattcccctcgaaagcatattagcaacattatcccaattgaccattttattttacttttgttatgctaatgcttttagttatttgtcaatttatacattatcatatttgtcttgttttattttacaagtgcctcaaaattaagcatgatccttttgtctaaaggaaagtaagtatatcccttctctatcatcttaatccgaataacaatatatttgagattttttcttgacaattaatggcaaattatattacgacttatatatctttcacgaatacaattttggatatcccgttcttgataactttcgaggacttgtatgaatttccgtccaaaagcctcggattacaaaaagaaaataaatatgtgatatatgtttatttgtatgtattatatttcccgggagatttgaaaatattaaactttaaaggagaaacggaggaggcttcctcagtgtactattgaatcctttgacacgtcaagtcaaatcggatctccaattagcttttgtctaaagaaatatagtaaggtttgtttgtcatattaattaggctaggatacacttgcggtcaagattcatgcgaaaatgtaatcattattcttcgaatttgaattagcattaaattaatcataattaacacgtgattagtaaaatcaatgattcagataaattagataataatattaatagtagtaaaagttaataagaaaaataaagaccatttttgtgggactaataacccattataaaatttcttttgtcatgaagttttagctgaaaatttgatattttacctttcatgattattctacaagacatgattatctattaaaatttcattgtgttaatattaatttttataccacgtctttttctccatgattatcgtagaataaacttttggtgtatagtacaagtttgttttaagtcacgactcacctacttaattgaaacgaatattttaatattttccggtgctttatgaaacttcttcaatattctatacacgtccacttatgtgtatcccaatctcttcttaatttaataacattgctcactttttttaccaacccaacagttaacaccacttgtatagtacatgtaattaaacgaaacacacaaacaacgtatttccttccatacatgtgcatgcaaattgtcttgtcatagagtctgcattaatctagctatatgataaataactacatacaaatattttaaaacctaataattttctttaataagaaatccttcgttgtggtttatagaaagccgtcagtggataaaaaaggcataaatgagaaaagcaatatagggaggcaaagctaaacaatttaaaaacactttttttaaaaaacataaacttcaacactaaaccttttcacaacaaaaaacacggaaaaaaaacaaacaagcgaagaaaagtattcttcaccttggttggcttattgtgtatgtctataaatattccattaaacacttctcttaaaacccaaaaccttcacaatctctttccctccctctctcttcctcaac

SEQ ID NO: 4332 - DNA, 2000 bp, Arabidopsis thaliana
gattttgaatacatgcaaacattacttgagtaaagtatcaaaaacttcattaccgaagcttatgatatagtaattgaattcgtactattgccataataataataaaaaattcatgtactaccacaattcaaagtagagacaaattactatattaaactctgaaggtatttgtgtgccgttgacacaaataaaattatcttagtatgtttttattttgaggcacaaattaatgatcaaatcgttaaaagatgaattctgggaagtatatactgagtggatattttcatttttgttggtagataatatccctcaaatcaaatcagcagtatttcttttcttgtaaaaggttttcagcatattagatgagatccacaaaaacaaatatctacacatcataaagcaataattctttgccaaaaaacaaaaaagcaataattaatttcgctaaaaaaagcaataattaaagaagttagaaattcctgagttttggggaaaacaaaactcgtgatttttaaagctcttccaggttggacgagatatatagtactgtagtctcttgtgattttttgtgctatatttttgtgtattgcgtcgcatatgtatgaccatgccgcatggtatgcagcaactacaaaacattcaattttaatttgtacgaagtccgaatgcagtaaacatatgtactatgtagtaatgtcacacgattctgaaataaaacatatcatggtcaataatcaagatgacatcgatgccattttagatgattttagctctggtttattaagacttgcatcttttcaaaaaaagcaaaatatctatgcgtagacctaaaggtaacaggatagagatttagatagaattattaaataatacgtaagacatacatgttaaagtccaaatcgaggaaagggaaattgggaaaatagagtcataatatcgacataatcagacgtttgagtcggttgacttcacatgtgcttaagtaaagagagaagggaaattgtgttttagatagttccgtacaatttatgtcgacattctctcgacatatagttaagctctttattttagtgtttgttaagatataatcgtattttttaaagtattcacgagaaaaacagtttcatagttacacgtagcatgtatgaacgtagtagaggatctttctcacttttaaaaatctattccctaaagattcgatttttcttttatttcatcccctcaaagtagctctcaactatctataatttaatttttaacaaaaaaaaataaaaaattagtagctccaagactaactatttgtagttttgtaccatggctaaaatttttaaaacaacatgttcgatggccgcatacgcatttcccttttcttatcaatttaaaattaattattgtttagattcttcgcgaatttgattacacagatcacatgggccatttgatcatcatgaccaaaatgattgcgaataatcgattattatttgtttatgttcgaatgaggatagacaaaaaattctgctcagtttttgacaacctcgagtaagttattttagaatcattttcttgaatcacatctattacaaattatttatgaaatatacaactaacgttcattcgtttttatttaaaatttaaatgttttaatttatttcgagggacaaaaacaaatacgggcctagtgatttttcatgtattttcttctttgaattatggagtcaaacttgtttgagttctacagagaaaaaaaagcaaattaaaataaatattgaatgtcatattaaagtatataatataacaaaaaattaaagaaataagtcttctcttagaacagcacctgttaaaatataactatataactgtgtaacacacactttgagataaatacatcgatcactcccaatctccccccgtattttgtcctttattcttccattcttcgcgtcgtcatcatttatcattatcatcgagaagagattcaaattcaaaccctaatcgataag

SEQ ID NO: 4333 - DNA, 2000 bp, Arabidopsis thaliana
tcgatcgttagatattatatatcaaaatcgactgaaaagattgttaaaattcataaatacttaagcactgtctacaattatttacaatttttggggctacatcattacaatgcaataatgtcaaagaatcataataaaattatttctgtcgaaataattagatgcaaggatctcttggataaaaacgtgcatgcggaaatccttaagaaagtttagacttggcagctttacaatctcgaatcaacttaaatttatcgaacctgatatgcgtatgcatatataaacacacatgctagacaaaaaaaagtatttgaattttatagttgacaaaaaatatattcgaattatatgtatagataatgagtttgtagtgacaagcatgatgatgcattgagatcacgataagggataattgaacagtaaatttgcgatgaaaacattaaaataactaaaaacagttgacacaccattttctccgcgaagaagaaaattcataaaatctaataaaaagtcacgatcatgtattaaaataaaagattattatgtcggctctacaccaaaataatttatctcgttatatcgatgttttcttgattcttgaattctaaaggggacttttatttatttataaattgagaactttaatgaaatttgcttttaggaaacacgagagatgattagttgcaaataagatcctcatcttctacataattacattagctctaaccttatttttcctttgtttcaaaaatcataataacctcttaaaataaataatacaattttagctaagtattatagcagaataataatctctatgacacatgataaacactttaagtactatacacgattaacaaccataaaacgctgaatatatggtttgataatttagtgatgtgtatttttacctttttatctttttaacaaaataataacacatatatgattaatgaataatgtattgaatttgtttctgctatattttactattaataacatcataacgttttcatgtttgtttgacaaaaaagttttcatgctttcaaaatttgatgatgttatatgctataactgtattagaaatataattagataaaaacgaaacattattaatatataaaaacaaatcttatattgtttagctcgacatttagattattgttttctgaagttatttttgtaaactttttatcttcaaattgaataactaatcataaaattagttattaattaatgtatggctgataaaaaaagaaaacaagtcttatactagctttttataataacttgtggatactctattataaagagtttttacttcttgataattgagttgttacatactcctattattcatacgacatacaagtcgtatttatagggttaggataagttaccaaaatgtggaatcacttgcaataaatgtgaaaacttgtggactgttgtcacaactatttattatatttagatctcacacaaaatttgttctgtcaagtgaatgtatccaacatgaaattggcaaaagccagctataaacaaaacccaaaaaaaaaaaccacctctctcaatagtaaacaaaaaataggataatagggtcatctaaacacaagcaaatatggacttatgctgttgtcatgatagataaaaatatgtacgggtcttttaagagcatcaaatcaatttagcccgtgggtccttttttcttttacttacttaaagacttagtgcaatatttgtcccatatctccctttacccctaccacaccccacctccaccctcaaacaattgttgcatataaataaggaagtgattgataaatgtagagacaaatacccatcaaactctgtctctcactttccttcattatttactcattgcccaaaataattcatttatcatatcctcaaacttttttttttctatacctcgaaatccaaaaaaataaatacattggtttagtgtggcattgatgtttttggtataaagctcttcacca

SEQ ID NO: 4334 - DNA, 1009 bp, Arabidopsis thaliana
tctattctgatgacgtggaaaaaaacaaaatcgcgaggtttaagatggattcgaacccgcgaggcttgagtatatgtgtgattggccaattggaatctaccgcacgagctgcttctctgatagtttcggtgctccaattgtttattttataaagccattactctaaggatttactttatttctttctatgggattattttaaaaattgaaatagaaaaatggttgaacctgttcgactttactcaatgttaacttggttagtccattgaaccatcgtacaagtgatgaagtaaacaacggattcgtctcacaaatagaggtttgttcatgaatataatgcttgtgggtgaagtgtggttcttttggaaactagaatgagaactcattggatgagttatatctcaaagaattggggaaagctatgtatgtaattgtttgtttcatttttattttctcaaaataatgcaaactataggttggtggattaaaaaatgttagaaaaactaaaatgtcatgttgttattcttttcaccaaatttcatgtattcagtatttatatgaaaaaagctttttaagcaacttgactctagtgtggcttgtatagacacatgtatgcagtctttttcttaacattatttttcattaagatctaaatgaatctcaaccgtccattcattagagaagtaaaacaaaacttacacgtggcaaccatcgaggtttgaggtacactgtttcattacctccactatgtttcatatatatataacaaaaacaagtcgccttccttcttagtaaaatttactgaaattgccactgttttcgattttgttggttctccgatctcagtggtgtcttcttctccggtagataattctcgtgttgaaaatctccggtagtgtttgactgagttacggtatgattttgttcttcattttcttttgcaataagtcgttgttatgaagtgagtaatccactggttttgactatagaaatcaaattgctacagaat

SEQ ID NO: 4335 - DNA, 2000 bp, Arabidopsis thaliana
gtacaaccgttggataattggcaataatgaatcatgtggttactgcgaactttacaatttttctatcttgctattctaaatttattttcaagctttccctatgaaaaaaaaaagatacgaattagtaattctaaaaacaaaacgaagtatatgtcaagggaagattttgtaaacctacaaatcagtaactagctttatagaacttataaattgctattgtataccctaattaattgttgtcaaatttgttgggcattaactaattgctgttgtataccctaatttgttgggcattatacttaactaattaataagttgctgaagccgatgtaaaattaacaatctggtgaaatagtgtgatagacatatcacatatacaccagtcttgtctgtttaaaacatcaattatttaaaacaatgttgcaaaacttttattattgttgttatgtgttactcatctatcattttgagaaagagtgtcattttgaccaatttcacacaaattaagaaaatattaaaactacaagtgtttgtctctatttaataagtgattaataacttaaattcaataaaaatagttgaggtaaaggtaaactagaaaattagttttaatttaaaaaatagcattgaaaatgtaaaacaacactatttgcgagaaaacaatttgtggaacgatactatttgtgaaaaaaagaagtactattaagtttaaacactattctttatttttagtttctgtgtttcgttattaatgtaagacaatcccaacatgaagacaatctcaacgcgatgaaaaaaaaaataaacaaaaaaatatttagccttaacatctaagtaccacatggattttttttcaggttttttggtatgcaagatcagttcaatacccgcctataagactccacactctaccctagttttgagaacacatgacatgcaagcgacctaatagttttgacttaaccttgtatcttctataatttgtaaaatggatcagtacataacatccttgcctacatacatctaaccaaaagtttatcctcttattccacaatttcttgctaaccttagatatgtgactgctactctttagtcatcggatttaatatatatggttaatgtacttatgaaaactgaatcctttggttgggcctttgtggtatgtcatccaagaaatctgacaagaccagacttaaacgaacaaattcaaaataacaacgattgtcatttttttattgtatcggaagacgtggaagatggtatttgatgcccggggaggatggtgtttcttaatatacacactctaaaaacatttgccacaaatgagatcgaaatatactcaatctatgcattattttattttatttttattattatgagtatctattgttaatagtatattcgttaattcacgtattgggaaatgtttctttttccagtcaactcttttaagactttcagtactatcgttactcaatattgcctcgaaggacaataagcgggtcctaaaatcgagtctgtcaaagcttacgtggcacttgtttgccacatcaccggtactaatgatctcatctattttgtcattttctcgccgcctaacgtcactccctctaaacagttttacgccacgtgtaaataaaaatcacccatttatttttctttgaattggaggataggtccgtataaaatcttgtttttttcccaaaatacattgaaaaagaaaataccagttttgtggttggtccccattcggttgtgttaaaattttattagttttttaaggcagccatatttgtctaataggacctatgataaacaatataacaataaaatacttcccactttcatatatcttataaattccgtgtctcttatatatataggattaggttttgaaataaacttattgccacaacaagaagagataacaaaaagaaaagaaaaagagaaatcgtaaaaaaaaaaaaaaaaaaaaacttatggaatattcccaatcttcc

SEQ ID NO: 4336 - DNA, 2000 bp, Arabidopsis thaliana
cgataaaccaaatagttatattacatcattgagacttgtaaagatttcatgaactaattctaatcatgagagtaaatagactttaaattgaaaagtactctaatgagaagagtaaataaacttaagtgaaatatttcatatatatactgtaactctaaatcctcagggaatcaggaatttataactcatatttgagtcctattaaaataaggtgttggattttgattatatatttttatttgttgttatgattgaattttgatttatgcaacacaaatatatatataaagagaacgactttgtattgcttagtaaattgtcgtggacaaattggattttaatcaggcgatattaacacttcaactgccgatcatccatatcaaaacctaaatcaaggtatgtccgttcaaaactaccactgttctacatttagtatttaaacctaaacattttttttttttaaacctaaacttgttcttaaccaagatgcacgtagtatcttgtgaatggttaattaacttaatttagtaggacgtaacaaagttataggacattactagaagtctagaacatagttctttcgtgatcattaaaacttcgatccaaatttttttgacacaatgtgtattaatttagattgttcgattcagatttaggtctaactttcttaggtaaaaaagctggaatttgtaaatatccccaagcttcaatgaatctagacattaattcgacagataagatttgcgtaaaatactatagaagatttagatgtatttcatattttcacttatctaggtttcataattaaccaatcagcgaattggtataaattaaagtttggattgccaaataccaaacatgtttgtatttatccatccaaatatgaaatcaaatataatcctatttttgaaagataaacaattctgttcacaaaaaaaaatcagaaagaaagataaaaacatagtatatgtgagacacagaaaaggatctaacacaacaaaaagaaaattaccaaaacgtatcaaagatttagacttaaattagggcttaaacatggattaagaatagaaccaattataatataagttaggagtgaggaaagtcgtaatcgaatacagctacacacgagcgtagcgtgcttgaaagagacaccaaatcctgttttagtggggaactttcttactttcactttttcccctcttttttttttcctatttaagaacaattatttggggtttttactctttttattttccctcatgttttttgattttatcagtctcttccagcagccctccaggtgtaactggtcacacattcgcttggcttacctttaaccaggtgtttctccttcttcatagattttagggatgccaattttcaatactacgttttaagttcctataccgtaatttatggttttattcgcatataacagtggcatttccgtttttttcccacaaagtcagattctcttcaaattaaaatttttacataactacttttcgtattaaataaatattttagaacgaaaaagatcatttagatttatctcttttaatttttattcataaaaactagttaaaaaattaaaatagcatatgattattattgagataacaaaattctgtcgagaaaaatccaccgaacatatattttagcagcccgtttcaaaacctttacaattaaattgattaaattaaacaccatagaaagaaagagacgtcaaagaaaggatctcttctgagttctctgactcaatttctgagctctctataaatataagctctcttcttcacacttttaatgcaactctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatct

SEQ ID NO: 4337 - DNA, 2000 bp, Arabidopsis thaliana
gagaaatataaatcctattatatacgaaagtataaacaaatcattcctttcgaatcttgacaaccaataaatcctaccctaagagatttaattatatattgattagagaaatgtattgtattcttcgaaacatatgctcatgagcacggacacggtatattgttttactgatcatcggtttaaacatttgaaattttgaacttactatctacatatgtcttcggtgaacaaacctttatacggattgataaataatactcttcgaatttattaatcttattaagcccacttggcgtgagaagaaggtatataaatactaatagtagttgaaatatactacaataattactaaagtaactgcagtagttaagatttaatttaaccatagtcaacgaaatcgacgctgatattgatatttattggaatttcgacttgcgagcctcttcacatgaatttaggctttgaaattagagttatgatcattgaagttaatgtagcgatccaagcttattattttaatttttaatagcatttctagtagtagtagatagtgaatttaatttggactgtccaatttcttttattaatacatagctgatattatgtattttattgaatttaaatttggattttaagttacgaaacaaatacaaatttagaagtttcatattgattaaaaaaacttattgctatccaaattatattaaaaaaaacttatagctatcgttttataattcgaaaacaaatttaaactaaacattatattatattaccttcattttaattacatatttacctaatgactattccagcaacaatgacatcattagttcaattgctttaaccatttgaattcttatataacaggggagaaagacaaattaaactagatacgaactgtgttcctcaatcaacaaagacatcaagagatttgttgtcttttcactcacaaattattaaagttaaacatcaaaattattatttatagaaaacgaccactgatcaacattaatatcatttttttattgcattattctaatgcctagcttattttacacacccaacaacaaatctatcaagtttctaattcccaaccttaaatgatgcgtattagtagaaaccaaaagaatgtgattaaatagtatgttttaatacctttgtctcctatgtttggttataaccacttgtaaatatatcttcctaaaacatttagtcacatgaactaagataaataataatgttgtttatgcttatggatgctttgtatatatctatatttaaatccccataataaatatttttacaaaaaataaaagagaaactagtcacataaaaagaaaaaaaagaaaaatttatgtagcaaaatataaaaattgaaaaagttaattggcgtgtattttctttaacaaaattcatatttcgacctttttttcttttataaatattgtgtactcattgtcatatggactatcaattacttccattacatgattggtcataaaaaccagaaaactattgccgtatggagagaaagcagagaagagaatcttccaaaaatgttaaatcttgtgaaacaaataaagcatagcaaagcaaagtccaaagtccaatgagctaaaacaaaatcaaaaaggtttctttatgtttttttttttgaagtaagaaaaaaaaagagtttataaagaaacagtggagaaataaatagcagaacaaagagaaagatcggagaaaagaatctttttaggctctctctcgcagacttcgcactcacacactcacttccattgctccaaaaaagtgagcttttttcttcctttttcctattttcctgatcatcttctttgcatcttatgtaactgtagaatctgactaactttcagtaacccaaagttttgttttttattttcattttttcctccagctgtgtgttctgatcttgcttgtataagtgtaagctctggcttaagcttttttttttttagttgttctaactataagac

SEQ ID NO: 4338 - DNA, 700 bp, Arabidopsis thaliana
tttatatctttacgtgttttcagtttcgttgttatggtagatcttaattatgtatttttgctaaaagtcttaattatgtatttatgtgtctcttatcttgttatcttttgtaacttctcttctcctttttagagtccaaaccaaattcatggggattctaaaatctaaaattcaaataagataaaccttcgtatattggtaaaattcctaatgcatcatacgtttcataaaacttcagccctaatggctaatgcataagtttaacagaatttggtcagtcacggtacaatagttttttaataatgtgctaaagtattatttagtttagtattatagaaacaataatcggaatgtagtagaatcgtttaatctccttttgagggcattatcggatcccagttcaagccaatgttaccaagagcattgttgcatggcatttatctgttacaaaagtccatccgattaagtttcacaaagagaattaatgacgcagcgtaatcattaaggttgcctatatttttttagacaagtggagaaccaagttgagaataataaattaataaacaaattaagaaaatattctttatatattcatttttggaaacaattgattgtgaggtacctttccctttttacatatagattgggaaataaattcaaggaaacaaaaaataatcaagaaacacagagagcaaaacac

SEQ ID NO: 4339 - DNA, 2000 bp, Arabidopsis thaliana
tttgccgatattaataaaagtctgttgtaacattttcaaaaaaaaaaaaaaaatcgagtcaaaccagatttaacatacaatcaaaccggaaataatttaattgagggctagctaataaatctcatataacaaaaaattttgaaattttaaaaacaaatctgccaaaaaaagtctgttagtactaaaaaggttattgtagtcataaacaaatcagccataacattgacatgagtaaatctgttatgctttgacactgaaaaacaaaactgtcatcactaaaaacaaatctgttatcattatgtgactgtctagtaattttatttttaaacaaaaaactgttgtaaaacaccagatttgttaacaagttaattaaatctctgattacacaaaacaactctgtcatgcctatataacatttttcgaggttaacaaatctgttataacacaacagatttttgggtacaaatagaaaatctgttgccaccataaagaaaaatatgcggtatggaaaacaaatcagtgacatatttggtttcaacattcttacttttgaaatttaaataaaatctgtggaaactatatgaaacaaatcagtcacggttgaaaaatctgcggaaaaaaaaaatctggcgtaatataacacagtaaagtctgtggtacaaaacaagtctgttgtaaaaagtctgtggttgaccaacaaatctgtgatcgataacaaatccgtcgcaacaagagccacagatttaccaaaaacgacgatggcattttcgtaaataaatgtggttttattgccatgctggaattaaatagtagtgacatttctgtaatattgtttttttctgcaaaggaaaataatgatatttttggtataattattattcaaataactcatatttttagcatttcttttgggtcattatgtataaaatatggattactctagtaattttcccttttatatatatataaaaaaccatttgtgtgtgctcgattttatctatttctatttttttttgaaaattagattaaaaaaattcaccaaaacttaacattacaagtttatatataacataatattcttatgaagtaagaacaatgatctgatcacatattgtgactttgaatatgttgatgaaaaattactgtgatattatacaatttttaattttaatttaatccctaaaacttatgaaacttataccaactgagtaatcatcaaaaattctattttttcatttaaaaaattcaacttccattttcaaaccgttatgaaactatgaaaaggatcggggttatattggttctttgattttcataaagttattgtcaacttgattagttttggaagtttgttaattagatttatgatttcaattgatttgttttttttgaaaattttcaattgatttgttattcaatttgtagatttgaacatttattaaaatttagtgttatttaactaaaaaagtcaaaatacacttaacatatttaacacatcttcacatactgtatatctcaactaaatatccaaataaacaaaatttagcatactttttaatattcagaaacttactttttaaaaatatttatatatatacacacttttcttatatactttttcttaaatttggaaatagtaacaaaactccaatggctgtttttaaaaaaaacaaatttaggttggacacatcttatgtgtgatatagcctcataatagtacgagaaagaaaaaaaaaaaaacaaataatacaaaagggcaaaacaggtaaaacagcctttcctcgttacttcatttccatattattaaaaaatatattattaattccgtcagctatacacggcaaaaactcacattatataaactctgccaaagctgcagagacaacaacacagaactagaaaagagaaacactattagatcatcacttctcagatttcgatattcccaataaataataaatactctcagttcttctcttctccaagaacaaaaaaaaaaa

SEQ ID NO: 4340 - DNA, 2000 bp, Arabidopsis thaliana
tattcttaaatctgcgtgtttttagttaaaataatttatattgtgaaacggaaagaataatattttttccgaaaataaaatgtttagtaaatttgtgtgtttatttcaaaaattatgttattgtttttcttttttttaaatgagttgtagaatgggaagaactaaataaacacactactcatattattattttttataacattacctacatgtgctttgctgttgctattctcaaaaggtaatgaatggtacaatagtatcccatgtttagagtatgtggcagagtgatcaacactatggtgctaagtgacaatcactatctttctatctacatactttttatattgcatttaagcacattttttggaaaaatataaaatggaatacatatgtgttatccatgaatggttctttttttataaacatcagttgttagattgactattttgtaatgtcgaaagctcacaacaaattaaacttttattcttatcccttaacattataattttttttgtctaaattaatcttgacaacttccaattccataatcgttggtgtaaaaagatttaagaattgtttacttcatcttgtgcgcatcgataaaaagtgggcactagtacgaaagtatggtttcccactatttaaaatcaaatcaaaggatccctaaaagcgcgtgtgagagacgcgtggaaatgtccaaaggagtgtgaggttgacaaaagatgaattaagagattattcaaagcctttgacattttatcaaagtcaaccaaatacaagaaaccggaaaccataagtggttttagtcactaggcgacaaagacaggataagcatcgagataccttcttcaagcacatacttttctctctttctagaattgcccaaaaaagccaaagagactattcctctctctatatatatatagaatataaaatattctaatatacgtattatataatcggcatatacacgtattgtgattccgacagtgctcatctttttccaagtgtgttcatacttatttgcttttaaaacaagatacagagatatgtttaatttagtaatgtctaaacaattgctatcactaaaaggaaaatatgtcaaataaacactaacatttagtaaaattgtaacgataggttggcacaataatggcatcggtttatagaggacgattcctattagtttgctaattacaacatctagtattagttttgtgcaatcgtcacatgtccttcttcatttcctgttttatatacaaaaattattcagtatgtttacaccatccgtacacaaattttatttttagttaaatatattttatagtcacaagttgtgtgactcaacaaaatattttcaggtctttttttgtaattcataaattcatgtctattaatattttcaactaataaactaatttttgcgagataaactttgaatggttacagcgatccaagcggacaaaccatctacaaaccgaaccgctttttatttatcattcacaatctatagttcgtaatgaagcagaaccaaaaaaacaaataaatttgatgcggattgactttaaactaagtttgcagcggtttgttctctgtcctaaaaaatagtatagattggaccgttgacggattagttcgcactaaccacaacatatccgtctcaaaaaatagtatagactgtactgctgacggattattccggattaaccacaatatccattcaaaacaataagttgatatgtggaataattacaatgtaacaaaaagagagaagaaaacaaaattgtatattatactgtatttgaatcataaataataatttaataaaatctttcctccatttttttcaaccctttttttattttcgtccatcttcagtctctttataaacatatctctctacccttcaaaagtcagcgctctcttttgtctcctctgcttttttctcttctctcctcagagattcgaagctttttgtctcccctgagtaaccaaattca

SEQ ID NO: 4341 - DNA, 2000 bp, Arabidopsis thaliana
tcagcaaacatcataaaaactgaaaaactcaatacaagtttgaaaacccacactaatataagacatggcacgtttgcattatgcttcctatattaccgactaaattagtgattgtcacaagtagccgacaacttttggacttaattagcaacagacttattgcttcagtaagaaaccaacagataagcgatgggcataaatggtatgtggctttttcatcctgttttcacgttttgaacgtcaagaaaaaaaattaataagggatttttgaatccatcccgtacgttttatatttataaatagtttagataaaccttaattcctcaactaaatactagtttcttggcatcttataaagaaactatatgcatttttatccctaataatatagtctgtagcgtatttgcctccatatattatcgccatattatcatagactgcatctcatttagggcaaatgtaatcatagtttttgtaaagaattgaactacctcttcgccttttttttttatataagacaattctttagtttctatctatggtttaatttgtattttgacgtgtatgatactaattaagattatgctatgttttgagttttagttgaataaaatttaatttgtaataattctaaaacaataaaaagtttagtgtaattttttttaactagaacggattaagagttaggactgatgttagaatcgcagttttttttttatggaatgacgtaaaagaattctttaataatcttacttggcaatattaaatggaacaacttaaaaggactagacaatattattggcgtgatatccaaataattacggtttaacaaagaataaaatggggaaaccctttggtatattggttatctaagagttcattaatatttatatacattaagaggttagagtttcgaggtcaagatattatgtttatttaaaaatttgcagattaatagagacaagtgtgtaggagatctccaacgatattcaattataaccgttcgtcagaattctacgcagatagaacgtcgttaggtcatagatcattgaaagtgtctatcaaaagcatggagattaaaaaagaaaaaagatttggagaaagaagtgacttttgtcctggatctattaagagtcgaaagaaatcgtccgttatacaatcgtgtatataacaattctcataatttacaatttataataccgaaaaaatataaaacaaaaaaaaaatattttaaatagaacgaatcagcctcaacaaaaaccttttttgaaaatggaaaagcttaggctgctttaacacgcccaatctcacacatacatattctctgttttcttctttcctttttgtaaaagggtttgctaattctctgctttgttttttttttgtttattaattctttacatttcctacaaagaaaaagacaagcatgaataactaacagcggttatactggaaatccgaagtcttttccacgtgctttctgatgaacatttaacataaaacgttcggactcttcgtgacacttaaaccaaacatacacgtacgtagctaacaatagacgtgtagattttaggtttacgtgtttttcaagttgggcaagaacaaaaaaaaaaagagagcctatgacgtgtgcaacaggataatagtgttagcaaaagaaatcatcagagccattatatgatattgtttgcttttcaattccatgaacgaacccataccaatccaaaacagcaattatcatctttctttattgaacaaacgtatctcattggtcgtgtcctaataaataattatatttcatatacatgtatatactttatagtttttgtttttccttttgctactctacatgactctcgatcgagggaaaaaactagttctcatgtttatccaaaactctatatcacctttttgatgtttttatataagaagacttgttcatccatactctttcaataaccttgacagaaaaaaaaaataaacacaaaatttcaataacc

SEQ ID NO: 4342 - DNA, 2000 bp, Arabidopsis thaliana
tcaggaccacgtcattctgtcatcttatttgtcctttgatattttgcagtagaataaatatcttaatttggttgaatgtcaagccaacattgtaattgtaaccaaaggcaatgagaatcaaacgatgatgtgagtatgtgacatgggaactagaaaagcaagttcctcctttatgggcccattaaggcccaactaacacgtggttacgtcaccattattagttgaacacgtggatcctacgatttttacacttctcttgactcgtagccacgtgtacgttaatgaatcagctaacaactaacgtccgcctcacggttttgttttgtttctttttattaaggttttggtttttgtgaacacggtttctaaatttgtcgttaatttttttttttctttctatataattattctagaaaaagtgggaatgtagagccgttatgacggctgcttcacgccgtttaagacacattagttaacgacccattcgtttggtcaagcaagaaattatttttctacaaattaagtatataacaccaaagatttgaaacgtaaataatactacttgttcaaagattccacaaaacaaaaaaaaaacaagtaagaaaacaaccgaatattatgactaatgacgaactcgctaaatacaataataagaaagtttataatgtggtcttggtcgtctgatggcaaagttggtaaataaatcaaacatgagaggtattttcgggattcaataaaaacagcctgatatccttgttaaccacgtctctctctgtgtctccttgagaaacggacaatttaattttaattgtgctttattttgtaatgtatttttgagagaatcggactctataaatacgaaagcccatctccttcattttctctcttctcctcctctttccaaattccggatttttagtgagctctttgcaatttttagggttttcttcgaataaagaaaaaaaaaatccctgatcttcctcttagtgatttctcctttcgagatccctgagattccgagaaaatctgcatttttttctcgtgattctctagctctgttttgtgttttacacagctcttttgaatcaggtacgttttctctcaaatcatttagtgttctgtttcacatttttaagtttctgatctgtttttaggttttatcattgagatttctagatctctctgtcgttttattttgtttgcctcatcaaaatgatgtttttgttttatttattgaatcctgctctgttctttcgtacctttgagcattggtttaggcaaaactcattgtataagaagttaaacagacttgaattgaaaataggaactaattggacatgtttagaattggttgatttgttaaaacgcgtgatgtggtcaaatattgagtgagtatgctacaagtttttttgtcggtaggcactttaataaataaatagttagatgtcctatagacgaaggcagtttgaaaatttcggtacttgtcaaaatcagtggctccctcctttttctttatatcattaaactacaagatgggtaacacatgactttctttttgactttttatgttctgttctgctttaaagacatgtcaagtttcttaaaaaagcctttgttatgaaaccccaaaagttactaaatcttgtattttgtgtggtcattttggtcgtatatacaggtttgtgtgtgatagcgttgttgtggtaaaagctttgtacatttgaagatttagagatgataaggtaatgtaaacagctttttggttttgcggtcacttttaagttctcatgaaaaaagcttttcaaatttgctgaatgttctgttttgtggtcatctttcagttttcaggtaacctacttttaatggacagttcaacaacaagcagtgataagaaaacactaaagaggtggtttttcattgacaaaagagttggataaagtgtgtttagaagaagccgtcgaatttcttagtttgaagcattttattgtttggagagttcg

SEQ ID NO: 4343 - DNA, 906 bp, Arabidopsis thaliana
gacacattaataagccaggccttgaaaccacttctgtgttttttttttttttttccggaacatgatcggttacttttggctgggaggatttaattattagagggctcggaagtttttgtaagttaaagaactcacttaaaaccctgaaaacatgacagttaatggtgattagctctcaatgtgatgaaaacaattggccctctgattttgctgttgcggtaatattatgacttgtgtacgtttatagtctttgtagtctgcaattttggcattgagctatttctcacgaacttatgggatcttatgttttggatttgggatttgttaacttatatgattaggctcaatagtttcacagaatattaaaaacttgagtagggtttaaaaaagaagcaaaaagctccgatgccgggaatcgaacccgggtctcctgggtgaaagccagatatcctaaccgctggacgacatcggatttgttgatgtctattcttgtaaatagtaaatatttagttttatcggttttgcatctaatggactaaaacatgaacacgagacgccgacaagaatgaatggggcaggcaccaaacatttgggtaaaagtatgcagtggggtattattgacaatttgaccattacaagagctaatcttagggggttttagttagtaaagcaaacccggtttaggagtaaatatggagtgagaataggggtaattaagggaatttaagagaagtcatcatcgttttccatttttcttattttaagcgcctcggtggctatctctcactccgttcgcgtcttcctcttaaaggaaacctcctctacgcgaaattcgtattctctcatttcttctacggagatttgcatcgaagaaactgactcgcttgtggaatcaacaacaagacg

SEQ ID NO: 4344 - DNA, 735 bp, Arabidopsis thaliana
tcgaataaacgagtgatcaatttgatacaatgattttattttattttgaataataataatgaagcttgtgattgttctttcttttgaaaattttgttttctcgtgtgatatgttgtaagtatttttctcaactatccaagtcaatctctgtaccctaatatagaagttaattatagatgacgttatatacattttccacataataaaatcgtaatttcgagtttgtttctttagattacttgaagacaatattatgcattaactagagacccagcgtaattgacctcatatccttcattatgtcaactctattgttcatatatatgataattcaaaagtttataatactatttaattacaattagctattgaatcagtttataatttataggttacaataaaactagacggcgtgatggatgggatcatgaagaataattccaccacttgactttgaattccaaatgagaatcaatcttgtatatatctcaccatcatcaaagcgcgtactgacatttttgtcccaatatagttagtatataagctacacaacttggtaaaatagtcaaaccaaaacacatcactacttcaccctaaagaagactcattatcaaaagtcgtcttactatttttactataaatatatactctcaaatcccttagcttaataagaatcacgaaaacaataacaaacacacaaaaagaagaagaaagaagaagaagatattagccatc

SEQ ID NO: 4345 - DNA, 1433 bp, Arabidopsis thaliana
agacaccacctctatcagacaccataaccaccttcttcagtggtgatgatattaacctgaaacactcgctttttattgctttatttctcctctgcattcagactattttcatactccatgcttgttattatctctcttaaagtatcatatcttatcgcacttttgggaagataatttattgcatatcaaactttaacacttattagttattactgtgagtattattcactaatgctctacatgcttttatggaacaagtatgaagtataggactatcttcgttttaaattcccctgtcgatcactttaatccaaaaactttaactttagatactaacacgtgttgaaacgtgtactacgccattccacgcgtcaggaaatcgagcaccgccgaattcatctcgccggagcatcaccgccttcgatcagtcaccgccgatccgtctagtagtgatggatagccttctccttgttgtcgatctcgaatccaaatccaataaacgtcgaagatctgccggatagaacaaagaagctgcttcaaaaatctccaagaaacaccagcgccagggaagcttcatctataacgacacccatattggtgaagtcgattctttgctcttcctgagcaaaaggaattgatgaagatattattccttgaacacaacggtgaaaactaagaggatttgtgaagaaaacggcgacatcgacagaaaacatggatggagatctaaaccagacagagccggttacaaaagctgacctaaagtcagattattcaattcgccgtagcgaaatttacagattccgattaacggaaaacaaaagaaaaaccaaatactaatctccgatggagatcggagaacggaggttctctctctctgaagagtacgagaggggtaaactgggccgcttatttcgcatgtacgttattgggcttctctttgtaattgccctaatggactgttttaatgaaagtatttggccgacaaaaaataatccaaaaactttaacgcttatacgttcactactcaatggaaagtatacacgtgttcgtacaagaatcccctagaatattttcgtcattccgagcccacagcttaaaagtccagaaacatccacacacgacacgcctttctagaaacgattctttttttaataccccacacaccctcagatctattatcaaccgttggattacgtggacaagtccaatgccactcgtatttttaaccattcctcacactcctcaacgtgatgtgaagatactttgctgtttcataacgtcataaagaacagtgacaggcgaaatttctcaagaaagcaaatcggaagaactcacaaaaaaaactaaggtaagagattattatcatcacttttgttcttccttcactcaaaactacgatcaaaatcgtgatttcatcgtctttggtgtag

SEQ ID NO: 4346 - DNA, 996 bp, Arabidopsis thaliana
tactcgattctcttgttttttcgcaattagaaggattcaataaaaaaaagttttgcagatagatagaggtatatagtgtatatatatgtgtctgtattgacggtggagaagataaaatcacttcgattccctttttttttttggctgaagctgtgttctgtggtttgccctaatttccttttcttcttctcacgtgtaaatgttattgttaattacgaaaatattctgtatatcaaaataattttatttattgaaaaagaattgatggaaaaatcttacgaaataaagacttaatattgtttttaatgcatcattatcaaaatacaagtctactttcacagaattaattaccaaagtatcctctgtctataatctccaacacaaaataattaatttttgggaaaaataattgatggaaaatcttatgaaatgaagacataattattttgtatttattgcatcactataaaaataaaaatctttgttgcatcattaaaagtgttgttggcatggctcttgcatgagttaagttagttaattcaaagattacctctatctataagttatttatttttgtttcctaaaattatgaatttttaagtaaatttgacaaatatacatatgtataataataaatatagttggtttattagattataatttcttaaaaaataaaaaaataactttatatgcatagattcctttgcaaattataactttattttactccctttaaaattaggaacatgatattcctcaaatttctcccatgttcaatgtgattatgctggttttagtttagatgttaaaataaaaatcctaaaaactaaaaagtaattgggccctttgttttaaagcccataagcccattaataaaaacattgacgtttagcttccaaacattggaaacgacgtagtttcattctccgttgcgttttattcttctggataagagcttcgtgatggtttgaaacctctgagtgaagaagaagcgcc

SEQ ID NO: 4347 - DNA, 2000 bp, Arabidopsis thaliana
aatcattgcaccaaacctaatttccaacaaatcaacatttatgcggcgaacttactccccaaatccaacgtaacaatcgcactatacactttttttttttaattccataaatttcatagttcttttttctccaaatttataattatagacagggtccaaaatgtttcatgaaaattaagtaaaaaagtaattaatattaaaaatgataaaatataggtcaattacctaaaaacagagtttttctttgctataaatggtaggttaatttttctaccaacattaaaaaaaaaaaaacactattatttagtagtaaattgtagtcttacctagattgattgaggaatttaatgaaatacttttacaaaaaaaaataccatgaaacaatatatgtgattacaaaagttaatgatctatgcgattaggaagaaaatgttcgaaattcaaagctattactaagatagttaaaaatatatccaaaacggataagaacgttcgatttaaaagtcatgtattcatttatcttatggaaaatattttaatcgaacacaaaattccgttgacacagattgagtcacacaatggataaacaaaaggatcacaattggcaatacaagagggcgtgtaagattggatgagaacaaaatgccacgagggatgaggagaggtggctcttgggaagaggcaaaggtcggtttattgcaataaccggcttttctagtttttttttaataaacagctctttgacgcaaagccaaaaacaatattggtcccggatttgttcactttccacattggattgataagaaaacataaatctgcctacatggaacaaaaaggtcgtcttgtttttcggatcacaaacaaaagcaaccttataatagtcactttttttcaggaacgtaaattatgcaaatattttcattttttgttttcatcttattttcctaatgttgggaatataatacggacagtgttacacggtgtaacttacaccgttggtccagctcaatacacaaatcaaatagaacattatctatgttaaattcttatgcatgttacaccaagtcggtaatatatattaaaaggtttaaaacaaatataagcaattgaaattaaatacaaaattgagcttgttagtgggacattgtttaactaacttctcatggaaattaaactcatcactcttgctatggttgagacattgtttaactaagttctcatggaaaaaatggggcgccacttaaggtataaaccaaaatatttgcgttaaaccctagataagctaagatgccatggaaacaaaacactgggcgagttttcttctcgtgacaattatcatcaaaaattatggaacaagttgatcctaatcctaatcctcttatcaatatctttgattgtcttaaagtttttatttattttatttcgtgataattgcattgtcttaaagttcatagttgcataataactttatccccaaactttcatgatctccacggaccaaaaaaaaaaaaacttaggaattagtttaccaaaaactccaactacttaaaatttcagatatttgttgtcagtattcaaatactacactcggaagtttcgttcgactatgatacatattctcagttcttttttgatgattcatggaagataaatttgaatatgaattctcctgttcgttataaattattgtaataaagacttaaagagtgatccagcttcatctctttatccacaaatgctattcccgtcacataaaaatgccaaaaaaagaaaaaaaagagtgataatctaagtgaaaacagatcacgagcgtgttagataagaatagagagacgcaaaaataaaatagatatttgcgagacgccacgtaagcaaccaaaaggttacggtaggacccacctcgctaatgtctatataaccagaaatgtgccaaagcctttcttcttcaaactaccaaacctacagaaatctctcttcttcttcttctctacaaaatttca

SEQ ID NO: 4348 - DNA, 2000 bp, Arabidopsis thaliana
agaaaacaaaagaaagaaaatcatatagatgtgaagcagacacgtttaggccacggcaatgacaaaacgtggcaccttgtaattctcttaagctccataattttggcttattgtattaaatagttccatatggtgtttcttatttttttttggcctatttggctttttatgtggtgttgacaattataacttgatccctaagcaatatctactttggatataatacaaatggagcaaaaacacaacactttcatttttgaagaaaattatgtaaggtgattgtgtgtttattagtagtcccaatctaatagagagaaattaaattctaggagtgatcattttctaggatagttaaaacttatggatgactttcatatgagtttagatctggattttggtggggggacataagaaatatagatgcatatgtaagtgtacacaaatgaatgggccacttgacacctaatgatacaaattttcaaagaaaactcagattgcaataatggaagcatatcaatagtagtatgagatctcaatctacaatcttcaataacatttaaaaaataaaatccaacaacaactgtagcgtataggaattgttcatctcttttcatcaaagaatatttaaaattttgttagacaagaattaattaatgatttatatggttgagaaaactttttaaaaagttgtaaaactcatcgaataataaatcatttttaatggaaaatatagtttttatttttattgtgtggtattgctcggactcaaggatacatggagagagaggcagagtcaaatccaatttttcaactatcttatatgatattcttctgtgctttttatagtttgcccgaccataagaactggtcctaactttcattttttttgtttccatagaatatgtattcctatgatttttttttatagaattaattgtgttagttaatgccaaattaagattctcttttttaaaatcactttttgaagaagcacttacaagagagttgtgttaagaatagattccagatggaaaagttggcaagaaaagatgttttaagtttttgccttgtcgtctaatccaacggtcgatcttcgttcatatcaagaatccttatgacgtggaccattctcttccctccatctgtacctcttcccaacctctattttttaatttacatcgaaaataaataagaaggattgcaaaagaaaaaatagaaaaaaaactctctgttcttctttcttcttcttcttcgtcgtaagccattaccatttcttctccctctctctgtttttctttgttgcgtatctgtacttagttttcaaacataaaaataaaacatatctttagctgatgttgtcttcttcttgataaacagattttctacagctttttttctttctaatttaataattcttgagactttttaaaaccctctgcgaaacagatgattcgagttttggtttcttcatctgtgttttgattttttcgtcttttattcttagtcaaacacataaatttcttttactactcttcgtagatgacttctcatgttccaaaacatcctcgtaaatgtactctttctctctttctttcctacacacacgtgtttaatctgtgttgttcttacacgtctttttaacttttgcgtttgaccttttatctgaatcctgtgtttgtgtgtctgtaaatatatatatgtgtgtctatgtgtatagtgctctgtttcttgtgattagactcatatgtcttattttcaatattaactataaatatataagtcacgcctagttattagtttttatcggtacgactaaatattcagacatcagttcacgtttcaaacctgtctcttcacatagttaagaaaataaaggcatcaaaaagattactagtaatgtttgtgtctactttatacatacatatgtcttgtttctttgtgtttttcagaatctgatctcttcgggaacgtttgtttaatttgtttcagcctttgaagat

SEQ ID NO: 4349 - DNA, 2000 bp, Arabidopsis thaliana
catactgtttttatatcgttttgaaaaactataaaaccagaaaaatcggattgaaatcaaacaaaaaaatctcatgtccacccttacttttatgtaaagctgtcaacttctttttagtttgttagccattaaattcagaaattctaggttttaaaatagtagtaaaagatactaaaccaataccacgttggtttaataaataaattaaatgatgcatctgaacggacttctacaagattgttgtccttttatggctgtcaacaaattataggttgcaatctacaatataatatcaacggtggagatgctacgatacatgcgaaattatagacattaaatttgcaagttaccactaatcaatgtgagcaagatatttggggaaaaagtaaaagtaaaacttgtggctgagatgaatcattgcaggatttgatcattttaaggaccacctttacaaaatattttagaattattcttattatgtttttaattgtagaattttgtgtttgggtaaaccagaatattgtaaaaatatttatggtcaatctataactcaatatcgacgaaccgaccaaactaaacaaagaatctaattgatgacacgaaacagtaaaacaaatttaacaacaaaaatctgtaaacgatatcaaaataattaaaaacgttataaaataacaataaaaaaaatgaaacaatttttttgaaattaaacaattgtgtaacaaattcttaaaaatggtaaacctggatacgagttacaattacaggtaaatatcttgatgtcattacgcttgagatattcataacggtcatggactctaagcttttctaactaaattgtctaagcttcttttacctctgttcttcgataattttttttttcatggctaaaaggatagatgttagctttgaacatttattagcgcaataagtaaatttagttatgtaggtgtatcatttaaatccaataccgtacctatcaaaatattcttagaacttcacacttcaaagacccatgaaattagtgaattgcatagtatttgtatctcaactaagtatacttagttttcttataaaaattgaagcataatatataaacatagaattacgaaattttgttcagtaccgtaaaaagggtttgtagcataatacaaacacaaaattttgttttgaccaaatagtttttttcttaaaagaaacgaaatatcctgactaaccaaacagaaaagataaaacgagagaggtggaattgcttctaattttagtaaagaagcatatgatagtctcctttaatatcttttaacgttactattcccaatttgttccaacatgtcttcttcttcacagacactttcgttttatccttttctcagtctccataacaaataaatagatacccaatcaatatttttcacaataatttttacaaaattgacatcaatgaaataactaaataattttactactattttaaatagcaaaataaacggttatgagtgattttatctaaaaatgttagattatgtgttcccttaatttctaattaattaaaaatataaatttttagttttgtcgtttatcagcgtatctaaaagttttcttccaatcttccactgccttcggaactcaaagaaaattaaaatcaaatttttagtaatataacagccgctcactcacggggctgtcacctaaaagtctatcacaaatcatccacgtcaattaaatatccttgtggaaaggtctcaagccgctgtccttaacctctgcatcacacacacgtcactgtagcttctcactttcgattttaaccgcggttgataaaagcagaaatatttaaccatggttaggttttaacccaaaggtggtttaagtatatcccactactcagcatcagtttataaagaagtaaagctttgccggagatttagcaaacacaaacacaaaaaacaaaaccaactcagacgaatgtgattttttcttcttgagtgaattgttgtaaaaaa

SEQ ID NO: 4350 - DNA, 992 bp, Arabidopsis thaliana
gaggtaaaaggacacaactttgacgccgtcaatgtttgcttttactctttcttcttcttttcatttttcttctactcggataatgtttttgcttctatatcgtttaattttctacctttttctgctgatcatataacatacataaaatcaaaaaatttaatatgataaattcatgttaaaagaacttgccaaataaaaaccgatacagaattttcttgtaaaacattcttcaatcttttttatttatttttttaactttaaatttccacttaaattaaaataaagaggattacaaggttaaaaaccccaacatggccgcaggcctaaaaaagaaagataaattcttcaaatttatatttacgtaaaccttcaaatttaataaattttaaaaaaccagacataattatgttgagagcatcagcaacggtaatttctcaacttccgtttctcaatatatgtgtaaacataaataaaagtgtgaacacaaatattattaatatttaattgaaaagtattttaattaaaccaatgattgaatgacaactgtgagaaacgttgtcgataagtttctcttggtttctctaaagagaaactttcccttacctctctcctcctttggacatttcttttcttattttattggtgagagattttatgagaaactcccgttggagttggtctgacacaggcggccctaggttctagaacggtataacgagaaaccaacgtacgacgagagaccaaaaagtaatattaacatatacgatcttacaaaaagtactcattattggaagtttggggcaacatcacaagcctacaattgcataatattctttggtcaattattcaatcaaatcaccgcgtaacgtgaccttaccttaatctaataagttgaccaacgcataaatgaaagtgtatataaagatgacttacataaacctcttagccatatatccattcattccaatataattctccacaaaattactatc

SEQ ID NO: 4351 - DNA, 2000 bp, Arabidopsis thaliana
cgccgaattcgattattatttaattcagtgggtttcaaatgggcttttcaattgggcttctgtaatattctgatggacttctctacagttactactgtaaaaacaaaaatatggtttacgtaattttgtgttgctgaggcaagaagaagacatttccttcatcctctataaatgaatgtcattaaaaaacaaaaaaagcagaaaaaatacagctatcatccacgatcctcgttcagctacttatctaaacaaatactactactatataaaaaagaaattgaatctaagttgtcgtaaacgtgcacgcatatctctcgcccaatccccaaagaattctactttatttttattttattgactcgcacgcattatttaatttcttaatttagaaattttgtattctatataatacagaagctgcattctcagagcgaatagagtggtgagtttacctttgcagtagaagaaaaggtgactatttgatgtcatttttaaatgacggttcctcgaaactttaaaacaccttactaatttcatactgtacacaaatgtagaaaagttttgtggctctaaaaagtgtttgtttccttatttgatcaaacttttgtttctaggtgaatgtagaaaagttagaccgatggctattaataaccaaagacaattcaagaatactttgtggaaaataaccaagaacacttcactatggtgtaaataatgttaggaagtttatcattccaaaactcatgcacatgaagaaaatttaaatgtttcgtagtgttcatctttcatcactgttagcaaatacattggaaactagctacgccaattatgaaacggaactaaaaataaaataaatttaacagaagaaaaaagaaatctcttaatctgaataaaatgtgtgttaaggaaaaaccagaaaactatgagactgacacgaaaacgtgagttccgcatagaggcggaaagattctccccgatcaaggcactaatcagagcctcgaatgtacacgtaagcatcaagggtaatttcgtaaacttcaaagaagtggagccctatgtttttgtgtggttggtcacttatcaggtagagagagaaaccaaacaaaagaaaattacgtcaacctctctccgacctggcacttcttcgccagcctgttcccagctgtgctccaatgtcttttaattttctctaccagccctcaactaactctaaatttcggatttaccctttatccgtacgtattttaaatactcaaaacaaattgtttaaaaactttcaaatgtttaccaaagaaacattatttgccaaaataagcgtcacattcgagcagagagttacccaatctacatcattgttacgattaccggatgtttagccacaatttagggggctacttgaaataaaaaagaattagggacaaattttctcatttaattctttttttatgagagaataatggaatattcatgctctaataacaaactctttacaacatgacttatagttatagaatgtaattaaaaattattcaaatgattttttcatcggtggatgtagcttaaccgtctatattaatgaaaaaggggattaaagaacaaaattaaaaaggtttggtaccaatattaaagttgtggtataataaaggcgaattggacaatttaggaaaatacagcaaacgaaaggagggaatgcaaaaatgggaaaaatgtaaattgtgcttgcttgtttgtctccacttaaaaaccagagacatacacagaaagaccaagaagacgactgcttcctccaatggttaggtcgtgaatacggcgccattaaaacgctgcgttttatcgtcgtcacctccttttcctttgcctaattcccctaagtcatcgtctcttgaacggttcctgccattaatgtcgaactcttcctaaaccctttttgttcacatttccttctctttctcttcctccgtctctctctgaaaaaccctaattgactcgttgcgattgaa

SEQ ID NO: 4352 - DNA, 1265 bp, Arabidopsis thaliana
ataaataatgataacgaaaactgaaaagcatgtgatgttgattagtgaaattgcggtgacgctgatttttgcagttactgttttgattggtgtatttaattctagttcgagaactcttcttgatattttgtgtgacgcaatacgagctacagtttttctatgtctcgtatgtttttatcagttttatctgaaatactataatcacttacaaaaaacaaacactaaattttattatgtggttgtgctagccttagttgtatacatacatattttcacttacgtacgtacggtacgtcaggtatcaatttttctttctttcatcgagtatgtggacgccaagttacatttttttcgtttggttttagcgtcggtttagggattgaagttcaaaaaagagatgcttctagtaaaatatcttgtagaattgtagtgccttttagaagaattaccctttggtctcaactcatcaccgaaagcaagaatatttttctctaaattctatacaccataacatcaccattcactataactaaaacaaatggaatgaaatagtagcaagaattaatgtttttcttttcatttaaatttattataattgcaaaaagaaaagttttaccaaaaaacagtcgagtccaataatcaatatgagtaaatggttcgcatttttattttaaaaattgaattttttaagagcttgaaaattgaatttaacaaaaaaaacaaaaaaaggatcggtcaaacaaaacaaaaagggttgaaaattgacttaccaaagtctttataaagttgataaacttttgccttgttataaaaaaaatctactataaacagattgcgcgtctggagataactgatttttttttttttgatatttgagatttattatctcacattttctttaaaaaatcaaatcagaaaaaagaagaatggaatcaacaatcatggaggattgttctagctagttaaaaaatgacttacgtaccgaaatttttttaaaaaaaattaatagtctcgataaaatatactcttattaattattaattaaccgattgggcgaatggagataatgatgttgacattcgagaatcacctgttctcacaatttttcattaccaaataaaaaataaatccatgaacttgtctacacggcaatgcatgcaatttcacagaaacttacatatacaataatattttagaaaaagataaataatgctagatgagttaggaaacaaatggtagtgaaaacttaaatcagaacaaacaaa

SEQ ID NO: 4353 - DNA, 684 bp, Arabidopsis thaliana
gttgttgtttcatctatctacttttttttgttttgtttggtacctgtcctgcttcaatactgtgatatactttgaatctaccagaaatggtcctggtttttaatttaaataggacttggtcttatggatgtcttttaatttggttaaccaatctttcttcattaggctgcccttgagtattctctataacttgcgacaaagtagacataacactctttaagttctaaaaaccactttctattttcggatctcgaaaaatcatttatcgttttgtgctgcaaatcagtgttatatatgagcttggcaaattaaaatgacatatacgtatagaaatgaattgataatactaaatattatttgttttcttcttttaacttcagccatactaactttcactaaatttcttaagagcatacagaagtttctcctcggtatattggtggttctatattccccgcaacgtgaatggaaaatgaaggttctattttggctatatgataatcatgccattagctgacccgaaactaatgtgttacaataaaaccaaattatataaatagaagaacatgtttcctggctccttattgcacaaaagagaacatgaacaactctttttatattaccatgatagtcctatgtgttttggcctttgtgttagttttaattgagagctgtgcgggcaaa

SEQ ID NO: 4354 - DNA, 482 bp, Arabidopsis thaliana
agaaaccttaaaactgtgaccatgttatttactttttcactttcttgcttgacaggcttatacgatggaactggaagcagaaattgcgcaactcaaagaattgaatgaagagttgcagaagaaacaagtgtgtctcgcttcttccctatcacaattaagaatctcgagattttcatattttcttgaggttgtattcactgaccaaatgtttcatgcaggttgaaatcatggaaaagcagaaaaatcaggtactgtcttgatttgaatatcctctatggttgttggctaggcttttaactctcactcataatgaattacacttttggacagtattctaagcttttgagtagaatagtgtaagctataccatgaagtgagacatatcatcacatttttgatttcccactctgcataaagtatttaagatttgtgaatatgttgcaatgccaatttggatatttcatgagactaatctgacgagc

SEQ ID NO: 4355 - DNA, 2000 bp, Arabidopsis thaliana
taattggtaatattatattagtttatggcattcaaagtttgggcaatgcaaatgtcccattaagctacatattgttattgcaaatttggataaagatagttatgttggctctttgagtaatcttttgatctggatcggatataatatttctcactcgcgtgttcttgtaacaatcttctttaactagaatattattcgaccaaagtttgtgaaattgatggtgtagtaggctctttgagtaataagtgataagaatgataaaatttataaacaaaatgaaaagtatgggcatataaaagtttatttaacacagtatattatttagacaaaatgtgcctttaggtgtcccaaactcaccaggaaataaggcctagaagacaaaataatattgcaaaaacatcactaatgttaagtgcccactcatactaaaagtccccacccaaccaaggaaacgggcaagataagggaattagattcaagagaatatagtaaagaaacctaaaggctaaagttgttcaataattctcaactttaatttgtttttaattcattgtataataatgtaaatctgtaattataactagtgaatatataatgcatcttgcaaaggtattattctaattggtattcttctcatgagattgttctggaagccgatcaatttatctttttatatgtatatataagataattggtgtttatttaaaatgttgacacaaaagaaaagacgcttctcttataaaaataagaaagaaaaaataattaaaagagatgcgaccggcaaataaattctgcaatgagacaaaataattgattctatttttgttttgtaagttgtaacacattactaattccaaaataaacaaagttgtaaaacttgaataactagcgacaccatcctcggaatgtaacattggaatatataacatataataagagtaactttgtataattatgtcaatcttgcgtgtttggaaatcaagaaaataaaacttgaattataagaatgggctagtgagaaatgaaaggaacataaaaaagggattatacatccacccaaactttacagcaatattccagaatctgaagtcacataaaactcataatttcaaaatcatagtatatctcaggatttgaaagaatcaacaacttaactaattaccacattttcatactgataaaatgactaaaagatatgtatgacctctttcttatgaagtgttctcatcttgtttgttttttctttatcaaggaagtttcaaatcattttgggcctgtattttttcccgctaggggccgacatgtaatccatttgtacatttaaatgatagccgtacttataccattttattaatgttaagaaaatgtgagtggaaacaatgagcgtatgaaaacaaacaaaacaaaactgagacgaatattttttttgcggtttttcgtgactgcaattcaatgttcacatttcgtgtggtcctgtgatgcatgacatgtttgttttttaggtggatttgtgtttgtcttccctgatatgtaattatcatttagtggtttcacttctttggttttatatcacttgattagctgccaaaaacaaacccaaataaacatcacatcgttactcgttaaaacaaagatattaacttatagtactaataatatatacaaatttcttaaacatgaaatacaaatttaaacaagctaagtgaagctgccggagtttttatggtttcaattgttgccacgcatataaagaaatgccgtctcgtcgaccacaataaagactaataacgttttcccacccgtttaatacacgtgtcaacctataattggcaattcttcgctatctatcaccgccatcaaattcacctaccctcttcccttccatataataagtaacaatacaccgatctaacataaaaacgcttcaacgtgtcaaaacattacatttccactctcacattcagacgcaccaatcctctgttttggattttgaagagaaa

SEQ ID NO: 4356 - DNA, 2000 bp, Arabidopsis thaliana
gtgtctagctttagattttggagcctactttaaagtcgtctccaagtgatttccagctaaacagtggtcacattaaataaaataacgagggtagcctcgttttcatattcatcctttaaaaagcagaaaaagcacattcacttcttgtgatccacacacttctcatttaccatatccatattctgtaaaatgtaaatgttgctaaccatacaatttcctcttttttatctgactcaaaattttctatgttatttacttaaactggattctgatcaattatggttcttataagttggttttagggttttaaattataatgattaattcaaacctaaaaaaaagttacgatgattaataatgttttgttcggtacatgttacatttatcggcttattttgttggaaatgttagttgggatatatttgtttagttaacccgtgtaaagagtccttatttggtcattaggttaggtgtatcagtatatgtaatgacatagcacttgtccattgtcccaagtcgcaatcgtcatcatttctacaagcatgaagcatctttttgaatctaaagtcttaattcacattgtgcttttatttccctgtccctacatatcataaaacgacatgtcttatcaaatcatcgacatacttatttgaaagtcacgtctaaaggataacctaagttctcaaaagccgtatatagttcggttcctgcatttttttggatccatcttagaaaccctaaaccataagaactgtagacgttcaatttcttacagaaatttatcaactccatgacaccaaatttaagtattttcgagaaacatacagagtatatatatcagtaacaattcagtatttgattcaatttattaaactatttcgatatatgtgcctagatggggtactaaactaggaagagtggacctgcgactgcaaatatatcaagtggcgcatgatttagtagcaacttgaattctataaacaagttgccgtacgtttttcccgataataatttgggtgttccgatccatttataaattagaagacgacgaaatactcatactgacccaaaagtctttgttttgaattaatatccgacttatgtatttatacagttttgatgtgatctctaaccaaagttgaccataaggttattgcttgttattaccgttagaataaaagtttcattgacacttgctaaaatcaattattcaatgtatatattgctaattacatatcattaacggtctagttagatacatacaaggttttcggtgacaataaatttgtgtacagctggaatggcaatgatcaccaaaatatttatttcagtctatttagattcttcaccattgatgacaaattcataatcatattggtttcgttgactagaagttagaacacataaataatctaatggaatgtgattgaaccgttgttatatcagtattcgaatttaacacctttaaatattgaataatatttaatatacaccacatttgtgccgtgaactccgttacccattacaaccagatgcattattatttttatactctcgagtgaaaacaagtaaaaccaattgttttctttttcgacgtttcatatatatcttatgcttctgtatattaatctattaataataatctgactctttttttgttggcttcctttgtctaattttgaaattacaaaactatgtatcgtcttagctgttttttccctcctacacacttgacccatcggccatcacttgtcgttttccactctgatttattctctttcttctacaaaaaattcaaacattacaagccatgtatatttttattatttcagtaataacatgcgagtgagaaaatagtataaatattagtggaaaaagacagacttccttaatggatataaacatcaaaattcaataattgcgatagagtatcaatcaagatcttacatataaaaaaagattcatcccccaaagaacggaacactcactcttctaaaacg

SEQ ID NO: 4357 - DNA, 2000 bp, Arabidopsis thaliana
tttacggtaaagtcaaatctcagaaatggttggaaatatttattttccattccttctttggttatgtttgttacgtgttgttctcagcatctcacgctccataatatctgagctcatcacataacaaaaccatttttgtcattttttcaaacaattttgggatttcgaaatggacccaatgtaaaagaaaaaatttccattaattctgtgtcctagaaaaatagttttgacatattttaaaattatttgaaattattaatatacctcgttttaatactatttactaaactataacaacttaatctgagttatgccaaaagtaaaaaataaacatcctattaagtgtcatgttaaaaagaatatatataataactatatcatgatatgtttgtgatatgaaagaagtaaatgtaaaaatgtttctagtttagtgatgagtttacgaaattacagaaaggtaagatattgcttcaatattaaagtggatgcattaagttccatgcatgtttccctttctctaattgtaatgacaagggacatcaaggcttaaatcttggggcaagatatcgcaagctttttggaccactatattttttttctccatcttccaattttattggatgcatcaaacgcgtctttggaccacagtcgcttttgattttcactgcaagcttcatttgttcatgcttgaaacagaatggaatgtctcagaaattttactattgatccaagatacttgatttgtcataaatttctaggtcggcaactactgcaagtgaaaaaggtcatcctcatacatacagttgttctatgacgagaatatccggatattttgtcttgattcataggactcaattttgaagatcatagtatcaaaaagaacttgaaacccgaatgaaatagtattcaactttccgttcttattagtttcactataaaaaaataacgaaaactttatttgtatttcgtacaaatccaattcaatagtgcatttattttttccatgtgctccttagatatactgcacgtgtagtattaaaatggttggatgtatttctggtgatgaggcttaagtagctcatagaattaggagacctaattaagtaactcggaaaatgtagactctaactcgcagtaatgtgaaatcttactgtattacactttattctgaaaatctagtagaaaacaccatgagttttttaatatgacgaaagacgaaactatatatacttgtaaacgtagagaactaaaatttatatacaatttagacattttttgttggaaatatttatgatatttttttatacaacttttatacgcctcttcctatgagtatttttagtattgtcggtcaatttcatacgaatacgcttaccatcattaacagaaaaaaacaaaacaaaaaaacgcttatttcatcaagcatagtacggcataaagtaatacaaaagaatatgataaattcaaaacggcttattaagtttttgttgttgttgttgagaggatggcataggtttattgagtgattcttatcattggatacctgttgctgaccagaattttcggccaaatatacataggacttttgttgtattttcttccatatttaaactataataaacaatgaaccaattaaaaaattgtatatgccatccaaggatttatactgatgatgatgatggtggtggttacatgaccaatgtgatgatgatgacattaatgaaaaggaaacaaaaaatctagcggtggctttatatatatcacatacttgaggagagtaaggcaatagctaaactaagcaaatctctaagacttgttctcattttgtttgttcaaaatcccattaaaaaaaaacacaatgcaaccttaaattatttccgtttagtctctctcttcacagtcctgacctctctcaactctcacaacattaccaaatacatcccataaaaaaacaattctttaaaaaaaaaatattttgatataaacagaaaaaacaatta

SEQ ID NO: 4358 - DNA, 1162 bp, Arabidopsis thaliana
cttctttcttctacttcttgcgatagttgttatatgagagtcaatataattcaatattttgtgtgagctctatcaatgactctaaaatctaaatatatagaggatgtctattgttcttagttcttctggaattgtgtagtgcaattaagtttcccttttttaatacaattcggtaagtgtttcctcttttgtaatagtcatctacgttcgataagtgtttgctaacgattcttattgcaagttattgattttcctttcctcatataactaagaaaggaaaagttacaatagaaacgctgagagatatttcataataaggaaactgagaagacgtgtttaatcctcttcgaacagtcataaatccaataaagaaaaacgttgactaatgtaagaaaaaaaagacaaaccaaataaataactaatccaacttgatgataatttagacaacagcagcttcctggtagtttctaaaacgtcggttcgttttctaaatacagaaaagagttgcgtgccgttttcactatcttaaggagtaattaattagtttcaagtaaaataccaaattagacaattccacatggtgatctttgatggcctccccaccaccgcacgtgaatttggaataccttgtttagtttcattatcaaattacacctaaacgcgttactaattaaattatttattgtctatcaaaaagccacgcaacaacagtctagcatttaaatcttcacgtgggtctaacccggttccggtttcattatccgggtatatgttttggcttcgtctgaatttgaatttgagttttctcattcaaaaaacgataaataaataaaatattggtcagttattctttctatggttcttgtttgatatagaaagaataacaggttttggatttgtctgtgtgtttggactttggattagtattcattcggtttaaccaatcaaaattcgcaaccttaacacgttataaaccatgatgtaatgatttaatcaatgatcaattaaatgtatagaaatttattttccatttccgcaacagctcaaaacgttttctctcttttccgattttagtctaaaaactgaaacaaacacaaaaagcaacaatttgtctttgaaaatctcctctgtgtatggttcagcttcggtttactaaatctct

SEQ ID NO: 4359 - DNA, 697 bp, Arabidopsis thaliana
cgtcttcttcgaaatttagaacagataaacgatttgatgagagtttgaagaaatcgaagagaaatgactattgtagatgatctgggaattgagaagatgagtgggctttagggttttgctcttctctatatgtataggctactaagattgattgtgatttgttagactttagatcacacggattgccaacgtggcagatcatctaccctttcaattattatgtgatctatggttcgtacatctccttttactttttgaaaataatgtacaaacgaaaagtgattttagtgaaatagtcctccattattaagctttctataattttagaccctgaatcttgatctgttacaagttcatatttttaatttacatcaatacatttattgtggattgatcatcccaatgtattgatggttatttaaaagatggccagggttgatcgattcggtttcatatgattttagttctatgatgtaacctttattgatcaagcaacaagaataaatcaataatttatacgatagccgacataaagagatttctattatcttactatatatagtcaacaaatatctataacagttgttcacatgggacacgaccaatgagtcactgccaaatacaagcttcaagagtgaagactattaaagaacagagaaatacagggaaaagcaattaggagaaggaacaaaagaag

SEQ ID NO: 4360 - DNA, 2000 bp, Arabidopsis thaliana
acactcaaaatcagcggatcaatctacaaaaatcaagtacctgattcgtgaacactgaatcttcaaaccataaatttcattaagaaatcaatcgatctgttaaaattcttcaggattagagaatgcgagaaatctggaggagagaagaactgagacaatcgtaaggagccgttggagaagaaagggcaaaagattttaaattttaaatgtcgcaaacggagatcgaagttaacgccgttaattaacttccgttcaactttatgggcctttttgcaaatcctggcccatttctatttagtcccctttttttttatttttttaccatatggtgcctaaaagaattgtatcggaattgattttatttttttatattgattttattatgggtactagtaactacgtcattgagaaaaattcgtgtgtaagatgatgttactgcaacttccacgttattattaataaacttgtgaaggattgttacgtttacgtgcacatgtattttattcttatatacatacgtcaacgttatgtattgagagaatatgtcctactaaaacaaaacctatttttgtttgcaagttcttttttggttttttttttgggttcatttagtgtaacgttttatacaaaatcgaatcatgttattatctaaaacaggtaaaaactataacaataaggtatacgacgattgtaatacttaatacttatccacacacgccgataagttggacaatacttttatcattcgtaacgaccaagtaaacatataatttaaatctcttcacaaatcctatgatatgaatatatgagtttttgtcaacgaattataaacatcttaattttgtgttttgttgtattaaactattcacacaatccatcaaagtcaacaacaacaaaacatgctttattccgaatcttataagttgataatatagataatagattccccggacaagttaaactagattcagtttgataagactaattcccacgttattacgatgaagcaaaagccaaatcaaattgtgtggtcaactcaaaatcaatctttttgttaaagaaggatattatcaataacgactaaacaaaacaaaaattaaccaacactatttctagaacattcatgaaagtattatctccgtataggctataattaaattataaagtctttcttatctctaaatcataagatttccctagtaatctccacgagctaaagtcagaagaaccaaaggcagatgagtacgccacgtgtacataacttgagcctcatacacacgcaaaacgattggataaaatagaacacatcatcatcatcaatttttgtacggttgtaagaagccacttgtcaaagaatcaacggtaaataagaactcttctccttcttttcgtatcttaaatttatataacaaaaatgttttaatatttgagaaactccatcaatcaatcataattattttagtttaatgattggagagaccgatcgtgaatttgtggccgttggatcaaaacttaatccaaaagattggagaaatcgatttataaattgcagaagaagacgactagctgttgagtacaagggacgacgaatttggtcggagggataataatggaaggagatgatcgataatttgggtttttagggttcctcttctctgatccttttgataattttcaccgtttttttgggggttttaaaatttcttcaaattctagttgatttcattttcaaattctggtgaaacattatttgtgtttcaatggtgaagcttagatcttgagctaagagttaagaaaatttcatctttttcctgtgaaagttttgtcctttttagattttgttttttttttattctttaaaccgttcattgatttcttctgagtcattagaggttgatttattgcaagcaaaagggttttcaattgtgtgttggttgctgtgatctttgaccagattttatggtggaatttctgaaaaaagtatcaatccggttcttgaa

SEQ ID NO: 4361 - DNA, 2000 bp, Arabidopsis thaliana
aagttttcaaaaagttatttttactcaaaataaaattattctaagtatattacaaatttttcaataaaataaattcgttatcacatactggaaatataatactcaggctacaacgtgataacgaatttattttattgataatggaaacagaacatggtttcttacgattatcttaacaaagtcttaattatctgacaaggtagctgtaaacgattccacgccgtacattaaataatctctttctcttataagatctgttgagcacgatggcttcgacgtgaatatagacaaaagtggccacatatattttaccaagataaagtaagttgaatatgggtattttaactttaaattatttatcatttataattttataatgatatattacacgttttctatatattttcgtaatgaagtctacgttatgattgagtgttgctttgaaagtttaatttatacagtttatggcagagtttaataaggttcctttaatcatcaagtctctctcagattcgttaatttttgtaaaagagtaaggactagaattcggaaagtgtgaatgcatagacaaatagaagagtttttcttatcgcacaaaatgttatctaggattcccgaaatcacggatgttgctattggccatcccaattagttacatactatataggttctttgttgatgagagagagtctcccctcatgtgtaactcttattggctctcccttgtcccttgctttggttttcttggtagatatggacatatggttaatttcatcttaacactaatccatgtccttttttcaaggttggtttgtaatgttcctttataagtataaatatacaatctccagacaaaaaaaaaaagagttcaaggttggtttgttacgcgagttttgacttccacaatctcgtttgataacatatccatgattttatggtattcggacgattttttattttagtatagacaagaattgtgacggtcgaaattcgatgttacaaggatgtaagctgtttgaattctttttagtgttatttgaaataaaactcaaagattaaaacaatattattttgagtaaaacactaaaacttaatatataatttttttaatttaaaaaataaaatgtcaagtttgaaatatatttgattaaaaaggatcaaaacaaacaaaaaccctcataggtcttcaatgaaattcgtattttagggtagccacaaaaaagttgggaacttagcttgcatctaattaatctgatttaaaaatatatatttgattaaactgtttctttttaaatatgatacgaaaatattatgtgtaaattaataacgatattatttcagtgaaaaaaagttaagttatacataatttgaattgaaattaagtacttgaatcatgtcaggtacgaccgtacgagtatccaaaaccctaattttttttttctccaaaccccaattttagtacccaaacatccaattcgtatgattgctaaaaaaaaaaaaaacacacatgcattcgtatcagctagtaaattacacgatctctctgtatctaaatttttccggatactaaaaaattgcagaattgatcggaattaagtaatactagatctaaccgtatataccagaagatgcatcaattcccaagttggccacatacaattatttcaaacgaccggaacaaaaaaaagaaaaagaccaaaccattagcacgtcgtattttaatattcttttgtcataatacatacacggtttatactttatacatacacctactttaacccgtacatgtcggcgtcgtacctttcctggtctcattccacatcttataattaaaatatacaacttgctaattgttactaattgttcacaaaaatgtcaaaacctaattaataaaacaaaacacgcaaagcataaaaaccctttaccttttctcttctataaaaccgtccatacggacaagctccacgacccacacacactttctcatcttctttctacaa

SEQ ID NO: 4362 - DNA, 2000 bp, Arabidopsis thaliana
agttgtaggaaaaacatcttatgaatttagatccattaaatacgcttatatgcatgtgtgcatgttcaatgtgtagataagttctattctgaataaattgacgaataacaattattgatttcaatttcgttttgagtgtgcatgtcatgtgtctgagatatgggaaaatgaaaaggaaacttccctatatataccgaaacaatagactatcaactttgatctatatatacaaattgtagaaaagccttggatctaactgatatttccttatgtgagatacacattaatgtcttttgttttgcttcttaagattaacgtgttatatattatctctttattttaaaacatgttgaccaaaataatttatgtcttacgtgttgcatatgaaatagatccaatcgaatcagcctcccatatcttgaatctttgatatttggggtctaccattgatatgatttactttgttaattacttgatgttaatatttcattttttcttaagaaattgtaaactaattctttacatatatgcatggcaattaacttagtcaacaggttcaacattttataatgtatccagaatcccagatagtacctgtcctgataaaaccttttcaggatctcatgatatttcttaaaatataacagcttagtgattttaaataacataaaaattagccgacaaaaagaaaatatcataatataattctgaaaataactaataatttactcttttcaagtaattattcaaaataaatttagaaaactaattcaatgtatttcctcattgtcactcttttatttccctctacaaaattatatatatgaagtagttttttttaaaatagagccccataactaacattaggggtccatatatttgcattgtaatttataaacacgtgtagaacattataattatttaaaataaaatttagaacaataacttaatgtatttcctcctcgttagttttcctttttttccctctacaaaattacatatatggaatagttgttctttacttcttttaagtagagccccttaactaacacattaggggtccatatatttgcattataatttataaacacgtgtagaacctggcactgaagtctgatgaatatatatccatttgttttcacaactaccctagctttttgtatcatcggttactttttttttatcacaagaaatttctcgattttgattttgatttttcaatgttgtgaagttgagaagttcaacatgttttggacagatgtttttgaacagtaaattagtattttaaacatgtgaatctatttgcaaacgtaatgacgtgtcgtctgaccatttcttgaatgttagttaattttttagctctagttttgattaatctaccaattaggtcattcatttcagtttaagtcaaatcaacaattaggctcgtcctaacgttttcatttagccaaaacaaaaaaaaagatttcaacagtataaataattcgtccttatcaaaaaattaataaataaaaaagatatacatcattacttacgtaattgtttgtattttgatagttttcgataatttctatgtgacggtttttaaaataaaaataaatgttgaataacaaaaaatagtagtacaatagaatactgaattggtttgtgtagggtcaaaccaacaaatatggaaagaaaagtattatttagttacaacgtgaaaacacaggttcgtgctactactccaatgatacgggtctcaaaatactcaaaactctggcatgtctcaattccacaaattattgtttaatcattctgcttcttctgtaagtttatatataaatgtgtatatactcaacgtaaatatttgcttacctcgtatattttctctcttctcaggcttattaattctctgcagataactgcagaagaaagaagaaagaagaagaagaagagattagagcttgagccataatatataatcccttgatcattagtctaaagaaccacataaaaag

SEQ ID NO: 4363 - DNA, 1571 bp, Arabidopsis thaliana
tttcaagttaagttaacatacaaatttttgaaaccaaagacaatctgaaatatatgatacaatatattgattttctagtacaaatgatagaaatactttagatgaagatcaattaaaatccaaaacacatgttggcgtggaatactctccaattatagattcatatccaagcacgactgaagaatggtctaacaaagatatatacatttatattccactttgtggaaaaaagagagcaatttaatcataaatcaaagcacctgatgtaatctttgtttaaacaatgtaaaacctgccaagttgatctaatgtcaaagctttataaactatatgataattctgctaacgacttgtacttaacaacaacttggtggatttaatacattttgttgactttcactcaattataatcgcaatacctctgcaataatgtaaaattcttggtcttcaaaaataaactaagattagtcttttcttgacaaaccctaatattcgttttgtttgcctgtatatgcattatctatctatggcttactcatagacgttaagagatagctggcctcttatagttatagctcatattctcagtattactatacattgtcaaccaagaaattctacatcaacctttgttaatatcccttgttaggtgggatttagtgggaaaagagatcaaaccttattttggaaagatcatttccaaacgctactggaccattatccacttggttcacaatttgcttttttaatggagctttgacaatcggaaactgtatgtgttaactatataaaaatattaattatgtgataattcttattttttattgttgcttttttaacaagtttgtaatagttaaagtgtggttgtaaatatatttttaaaatttagtactggctaccttgatgcacattatttgtataaatacctgagtttgtaagaagcaaatcattgaatcaaacaaaatgatctttatctttattttttcctgtccatgttgtaatatacgaattctctcttttacataattattctacaacaagttacataagttacgtctataattattgtggatcagacgtaatgtttctttatgtgaatcagacgtaatgtttcaaataggttgtaatatgtaattgtttttcatatgtagtaaatccttttttgtaacgaccgggttcaaactaattacttaaatcaaaccttgttatatccttgtgctccaagtctaacgatcaatcgaagatttattatgtttggtcaagggtttaaagaagacatatacaaaccttaatacaaggaaattcctatacatgtcggagtcttatgatcataacctattattttaaacacaagttggggttggaacatgtcaaagaaattcacacaataaaccaaaaataaagcaattctcgcaattattcaatcttcatgtctggcttaagttgactttctttaatgtattattccttccaatctgtgtatgtgaggtatttctcatttacgtagctccttgttttcactaagcaagtcttttttatgttcttgatttccatattagctttccaagaag

SEQ ID NO: 4364 - DNA, 1997 bp, Arabidopsis thaliana
ttgccgtttcagcgaaattgataagggttttaacggtctagggtttgttcgttgatcaaaacgaaacgaggattagcacttacctctctaagtcatagagaaggttataactctataggtcaaaatttaggcctgttttaaccttttcggcccatttaacgcacggtccaatacgattattagcccaaggaaacaacaaccaactcgctcgctcaccgtgcgcttcttctaaacatgtccatagaaacataaacatactaaaatgtgaaaagattaaattaaaaaacggatagaaacatatagaaagccacgtgatggtagcaaacagatttagtggttacaaccagatatcatttgatattgagatttatgaaaatgtcctttttcaatggctccgatcggtcagtgatcggatctaatattataaaggtgtgttgacccataacataatattattactaatacaagtaacatgcggtaattaactctatgtcgatcttttttctctgcatatatatcttttagtcggttttttcgttcttgctaatcgttatattcctctacacatggcaatggaaaagaaacgagtaacaacaacaagtagcctgcaaataattaagtgcgataagacaactctgctctgattggaaactgatattccggcccgtcccccttttattacgtaggagtaataaaattgggaacgtcaacttatattaatcatgacgacgttttctcaagggagcaaattgtacgttacgtctcatattatcaccacttttttgcagcaacacagttttatttcacacaatacaacaacactttatattatatatgagagtgatagaattttatcattccatatttccatgatataaagggttccaataattggtccaatttttctaataagacttttcttattctcatagactcttcttattcatctttcttaatcaattcgaccaactcagtggaagacaaatctcacacgaccctttccactttttggtaactttattattaatttattagtatggtgtagttcctttctttcttctgctgatcttgtcaacaaaatactaaatttttcctaagcggctgtttatatattattaacaaaggtttccgcgtgtctcttgtttaactagtagactaaaaacaaatcgtaaactcgattttctcaaccaaatttagaagatactacggcatgtaattagctaatgataaaagattcgaattttcgttccaatggatttgtcttttcttttgcccaaaaccaagaatttgtcttctcttggcagtatttagctagacaacgcatatagctatatattttgtgtacactggtcaaggtcgtggatacgtcattaataatattatttccaataagtcctattaaaacattaaacaactttgagttttaaaacaaacttagtgtaaagaaaataaaaatagcagacagtttacgggtaagactagatgaccatatatgattgagtgcataaaacatcttttttctttctttttttgaaaaagcgaaactaaaagattattagttgttggaaatcagcttagcgtaatcttcgagaaaatgactctaatgctaaaatactgatttaatcaattttctaatggtttgacccaacagacttttttttttttctatcctctaataatatataatcatatagtagtaattatttagtagataatatgattaacacgtgaatagcaaagtttctatcatttttattcaaaaaaagattcataagtaataaaatgatagtcaacttttctttttctttttgtgtttggccttttgttgcagcgtcattgttgtacaccaccagtcacactattgtgggatgtgataatcggtaccttttaatgtcaggagcttctttcttacattttccacttcaaacaaaccgataattcagaggaattttctcttcctctctctctctcttttttatattttttcactgggaaaa

SEQ ID NO: 4365 - DNA, 1407 bp, Arabidopsis thaliana
aacaactggcaaaacctgaaaatgaagaattggggggtgaccttgtaagaacacttcaccactttatcaaatatcacatctattatgtaataagtatatatatgtagtaaaaacaaaaaaaatgaagaatcgaatcggtaatatcatctggtctcaattgagaacttcgaggtctgtatgtaaaatttctaaatgcgattttcgcttactgtaatgttcggttgtgggattctgagaagtaacatttgtattggtatggtatcaagttgttctgccttgtctgcatttaacacttgtgttttagatctgttatataaagccaaaaaaggttttgtgtgatttggtactatcattttattttccaattcgaatcccatacttatcatatccattgttctgcgattcatcatcaacccataccagacagagcatacatgtgagttcggctaaattgcaaaaataagaaagaaaacacgtgttgtgcttcctatattgtactgtttatagcctcaataggagtttgtggattatgtaaagaaaaacatcttaatatcctcgaatagttgggttactcagctatttagaaattgagaaatttaggattagcttcaactaagtccatataattttgggaccaatggcatgtattgttattatcaataagacaataacacgtattatgttttttaaattttggcagtatatcgatttgaatatgactgaatgtgaagtatgaagtatcataatgattttaacacaaatcaatatgtacatcactgaaagtagttctctcagtgaaagacacttgtcattgtcagtttctttcttctggtcaattatcttctctttttaaaaatatataaatacagtttttttttggtcaattaaacacaataagaactctttgtttcatatatataatatcagtaactctttggaaaataaaataaaaaataagaagcattttcatagcaataataacagcagtgaattaacacatacaatttcatggagactataagtaagagctacattattttgtgcatgatagaaatttagaaagccacatgaatgtacgctcgtatttttatacgtaaataattgatcgtatgattttcgaaatttcgtattcaataattactccagtgtccatcatacgaaactgccaaaatatatggccccgtcgatcttgtcgtcttttctttttcgtttgtaatgtttaagttcaaccactaatatccaccacacacaaaataaaactgcatcttagagaaacaatccacttttgtttttaaggttcaatttttgaaattttcaaaaaacaaagcctatttcatacactcaccagtgcttcacaattcatcataattcataagccacgcaaaagaaaataaagtgaaagattcc

SEQ ID NO: 4366 - DNA, 1247 bp, Arabidopsis thaliana
ctatatgtgtacgcagacgaaagaaacttgtccatagaggacgtgtgtgttttctataatttggaataaatgatcaccatctatcaggatgtggtggttcctttgtacgtttatagtttgtataatattttgtcatggaataatacttttttcttgtgtgtgcttaaaactgtaattatcattagatgatgcataatgggagttattaatatttcaactggaatcttggcatcaagattcagatttccgtgtatgaaattaacaccggatacttttgttatataaaccgtcaagaatagctaactatttatgtaagtgaaatctaaaatattataactttatttttactaatgcatgatatcaagtatcgaatctcttttaatttaagtcgttcaattagattaaactataacagcaattattatgtttgaaaacattctgttaataataaaatggccatcttgcaaaaagaaagaaaatagttaaatatgatcagccatcatcacaaattagtttaaaacaaaattattcgtggtggctaatattatcaagagttttttagccatcctaggtcgggaaaacacaatagtcagcgatgtgaaactccaacaactatgcatttttatggaaaggtttcctcatttttcagccatcctaggtcgaaaatacacaaaatcggtatctgaatattaatgaagatgctctcatatcgctacactcaccattaacatcttaattaaacatagaaatttaccatcgacaacgatagacggatgatccaatccatgatacagtataaacagttacgaacatggcaattactctatctacaactactatacgtacatatgtcaggatctccaaaaactatatacataagacatacttttttttttgctaaactatataagacatactgtaatctgtattattctctactaattgttaagttttatacataaccaatatgagaatgcaattcatcatatgatcagaatttcactaaacacgtcaattactatggcgtgtagctatgaaataattacacttaatcaattggccatttggcctactatattagaccgcagatgtatacgttttctaactataaatttgtaaattaaatttttgtttgtggaaaaaaaactaaacattataaaaatgtattcgaagatacaaaactactatatatataacgtgttcaatcctcacttcaaaaacccacaaaaactttagaacgaaaaaag

SEQ ID NO: 4367 - DNA, 2000 bp, Arabidopsis thaliana
cggtaatccgtttataatttgactaattagtatgtaactaattcgacataaaatacggaaaaagataaattaaaaaataagttgtgaaaccgttcgatgaaggttgggaagaaggtgcaaatgacgtttagtgcgttactaacgtaagagacagttacacacaatttcaaaaacagttccaaaaatttgacacgtggcagtttgcttaatggacgacagttagttgtttgttgaggattacagcctggattttcgtcaatcaaaaactatatattataaataaatatgatttcattcacattccaattggcctaacactcttttgtcgtgttgtccatgtcagcaaattttatttttatttttccgaccacttacttttatcttgtgtggccgtttctttgtaacaagtttatgaaacagaatattaatcgtatctaatcatataaatgtagtttcccgtattgtgtaaatactatatgactttgatttggggcattcaaaaacgtaccattaacaaatagtcacagacaaaaaaaccatacaaaactgaaccacatttctataaacgatacaaatatttttatcccaaatttgtagcactaggcagtttgaacctttttcagttagaaagataaaccaaaaggaagtaaaaaatattaatttcatcgctcaaaactgttacaattactgtttaaccagtcataaattagttaatgtttttttttaaaaatgtgtaatcaaaattttactttcaagagtgccagctctatacttgcaattactttaaaatttaaaaatatacaaattttaaattatgtgtattgtattctcgagaaaaaaaaaaaaagaaatctatgaataattaaaacgtagcataaccgttacaagtatagtttcaaattcaacgaatcaaaatacttttttaaaagtagctaatacttttctcgtttcaaattaaatgtcgttttgcatattaatttttgtgtcatattaaacgtcgttttatattctatgcagattttatgtataaactttattggtcaaaagcgttacgaatatcgtttcaagttcaacgaatcaaaacatattttataaaaacatctaatacgttttccgtttcaaattagatgtcgttttgcattttaatttttgtgtcagtctaatgtcgttttatattttctacacatttatattttcaaaaatttcagttttatttttattgtttaaatatatcatccaatttgaaaataatacaatacaataacaaaaataacatttaaattaaacaaaaatatttttagaacactgtgatcaaattttatcctccaatatttcccgacccataaactttaaaccttatgtaacttcaaaaaaaaattcaaattagtcgttttgtattctacaaaataaaataaaaggaaaaaagtttcagagaaaagggtaaatttgcataacaaggaatacaggctggcgtgtccagtcaaaaaagtcagaaatctgcataaaaaactgtctttacccaaactgccaaacctaaccgttatcgtctcagatattattattatttttcaaataaacattcaaaacagctttctaatttttcacctcagattgtgcgaataatatcagagctctttccttgtaggtttccgtgattttgtcgctttaacttcccttcttttcccactctcttctcacgcgcgcgtgcttcccctttctctctttcgactgtatcacacgctccataaactaataaacagacgcaccgagatcacgacacgtgtacacctacagctgtatcccaaaactttcaaaaccgcttgcgtggaagaagcggtgcatgactttctccaccgtctctaccggttaccggttattatccatcctcctctctatctctctctctgttataaataccttttttctcctctcttcagtttcctccaccttcttcttcttcttcttcttctctacaacaaacaaacaaaagatctgtttca

SEQ ID NO: 4368 - DNA, 1838 bp, Arabidopsis thaliana
cggaattggcttcacttctcttgattggtatatagctttgctaaatgaagtctcattttctgcttttgtaagcttgctttgattggaatgatctcgagactttgatgtgagagatctttgtggttgcatcagtgatgaagtttgtgaatgtagtgagaaaggagtggttaatataagcagctctctaaggtttgttttaactctacttctcagtactcaactggttaaggttattttcattgttctgctgtattgttttcgacatcttaatccaatgtgtaacaaatatctcattgttaagccagtttgagaatgagttgttgctaactatttgcttctaagaagattgaatacttttcgacatggaaccttaatacatattttctattggacgtggatccagataacctttagcagtttatactttggatcacatcacatctcctttagtggaaaatgaatcagtttgacgatattgagttttcctgaagaatcttgaagctatattctaaaggtttctttcagtttgcagtcacatgttcttcttttgtctctttcaacataaatgtaaagatgtttctgactaaaaagcatgttatgtttgcctgctttaggtccatctcatgcttgcgcttcttttcagtttttgtgtttcattttttggctggttagtgatgagaagcttctttcctttctgtttttttcaaattagagttttctggatacttattagttactaacaaagagagggcttcttcgatattaacttttaagtatccagaaaactctaaatttgaaacaaactcatattttttggtctgcaggttatgtgtaaacgtctttgactcgctgcttcatacacctgtgcaattaaaaccttgaaaattttaatttcctagcatggagaatataagaagtcaatcaaggcgtagcatgaaaattttcatttcctgaggttggagccggaaccacaagggaaggaactctagtatctgccttggtgtttatgctttgttgcttcaatacgcaaaaatgcaccagaagaagaactctttacaccgagtatgtgatccccattcacgctgatagcatatcaagtcatgagcagctgcagtgctggagacgtgtaacaattgcattggtcaacaacttacacctgtttgtagcgaaccaaccacaaatccagcttagctggataagtctgaccctgccaaggtaggaattctgtatccactctctgcatttcaagctttcactatctctttgagcggctcccacaccaaactgacttgcaaactaaagtaaacctcaaaataaaacagagcgtgttatggttagtaatcaagtctcttccagaggtggtttaagtttaactatcatatacattaaaaaaaaaaaaaaaaacagtttgatgtgataatcaatgttaaaaaaaggtaatattgacaaagactcgagttgacgagagatcaaatggctgtttcgttattgttaaatgggtctctattctatattacgtattctttccatttggtgttttcttgtacaagttaccaaccgttatggtatttgactccgtcagaaaaaaaaaaacaaattgttaaagtgaagcaaacgtagacgttgagatattatatggcatatgaagcatacttcaacgcccccttgtaataaagtagaaaatgtcttagctttgttattggacaatggattatagtattgtagatttaggaagcaaactagaaggtgaaatgagaattgttctccgaaattaaatagatgatatgatgaagagccctgcgtaaagatcaagtttggagagaaaataaataaagaag

SEQ ID NO: 4369 - DNA, 1993 bp, Arabidopsis thaliana
aagccgatgagtacaagaacactcccgaagccaaataccaaacaaggtaaacaaagggaacaaaatccaaacaaaccaattacactatattcattgaaatttcctcgatcaggttctagaaatccaaaaaagacttacaaatcctaagtcatagaaaattaaaacaaatctgagactaaaaaagacacacaaacgggttacaatacaagaatctccttttctttcttggtataacaattttttttttattataaatctctcttataaatttttaatagtaatatttgttggaccgaattttttatatttatactaatgaacttttctttacgattttgttaccattttggtatcatttttacgattttaatttattaacctccttaattaaaatcgcaacctattctattttattaacacaggtcaaaatatatttttttctgcgctcgaccctaatatgttaacaaaatggttgtttctgcccaaatctcattatatttgtatggatagacgaagagcattttgataatactcttttggaatgtttctttatcattctaattaggatcctacatcgaaagtatactataaatggagtaaacacactcatgactgctaagtgctaacactagtatatatggaacacaaccaatccaatcattacccattggttttaaattagaatctgatgaaacttaacattaactttctctaatcattaatgatattggtagtcttataacaaatatattgccaagattcggtctaagaccacttgatagaactatgtataaaacttcttttttttaactgccaaacctatataaagtggacgtgtaaactaaagcatggtgatcacttcacatcgcaccaatgtagtggatctaaacgtctctttgtgtaatcacgtggtcgaattaatggtcaatcatttagcaattaaccaaatttgaaataacatccgaaaaaagtcggtttagtgggaggagaagtgagaatgatgtttcatgaatgctcgttaggaactcttcgaaagacgataacctcggatggatgtttatggtgtcggcttctagtggttaaacataattagatcgtctactgaaaagttggagatgtggttgagaaactcgtaccctacatatggttactcgtctgctggtttaatcgttgggattgatcgtgtactagtctttcttaaaggccaagaattttgtcgtcgtagttaatatatgttggcgtacgttttactgtttttcttgagaaataattggatcttaagcttattaaaaaagtcgtcacgacttggtccaactcgtacatatcacaagttgctcggcgcttttcatgttagttagccaccgacctcgaactttgaaattttatattttttaacttcaaaaacaattctttgatagttttgttttcattgctaatatttctctcaatttttttttattgtttttatttttgtatagaatagtattcaaaatgaaactataattcagtatggaacactttctgttttatttaatatttacttcataatgaattatgtttcaaattttcaaagaatatatttatatttgaatttggttagtaccttccaaagaagcttaattccccacattaaaattcaacttggtcttcatattaacattattcaattgaattcagactgaaatggttcactttatctggtttgaaatatatgtcatgcattttccaaatcaagaatgaatcttcttgaaagaaaaaaaatgagaaaaaagaagaaggagaggaatgggtctcctaacaatgaaaaagagaataaacccttaaataattgcaactatataaaataaaaagtataaactccactaaaaaaagtcaaaacgtagaccaaaacaaaaacatgtaactaagtcgtccactactacatctctatgactctatataacaacaaagccaaaaccacatcttctcacacaaaacacaaaaaagaacaaat

SEQ ID NO: 4370 - DNA, 2000 bp, Arabidopsis thaliana
ttgaaaaatgtaagtctataacacagttttacatgacatgttaatgactagggtttgccaaaatatataaatacttgatttgattagttatatgtccgaatctgttttaaattatcatacgcgcgccaattacaaattgtttatcacaatatacaaactacaacaccatatttcattatagtaaaaccaaaatttaactacgaatctgaacgtagccctgctttatgataaatatttcccgaaaaaaaatcattagaattcctataatgataaaaaaaacgctggttcttatggtaacaccatgtgaaaagtgatgactttttcatagcagtagaagtagtcaactacctcagataagtactgtaattaaataaactaattgcccaaaatgatacaactttgtcgcattaaattaaaagttaaaccttcactggatgcattaccaaaatggtcatataacaatacgtaatccaactcgctgtagctatcaatctctttatcacaaccaaccaatattcaacaatgttgttttatttatttttcatatggtttatttaatcacctcgacttttttggcatcgatcacatctacaaataaattgttagttagcacgaccgttattattactttatgaagaattgttaatctgaaaaatatccttttgatatcagttggaaatatttttttaaataatttattatgtagagcttgcggctgagtcaaataaaaataaaattgaaaactaaaagcgtgattgacaaaatgactttaaaggctgatttgtttttgaaaaaaccaagttcttaagaacacatttgaaccaatcatcgaaatatatggtggaaatatatttctaccaaagatttgttttttaaccaaataattgaacacaacgctaactgaatattttataaaactgatacagatttattaaaaattttgctaataaacattataaaattgcttttaccaattataggatgtattgtatctcttggactttaatatcgttgacgatcttgacaaataaaaagctggcgtttcattaaattggtatttacaatgagaaaaatgtgtgggatccaaaactggatataggattcgctttactgtatctggatccgaaactctaaaatatgatgtttcttatgatctggattttttcaaactataaatgatttctgaatttccgtgtatgtcaaccaatatttaaaaacagattatatttcttaaatatttttcagattttttgaaaaatattctgtaaattacaaatgcaaataaattatttaagaccgttaaggatcaaatatgtttttagtttattcaaatctctcgttctctcatatcgctattttgtacttagtttagataaaagtattaagtttggcttcttagaatttgatgtttctttttttcgtttttgctatcgacttttgttttttttttttttactattttggtgttatttatctattccttaaattttggttttgtttctgatacttatattttctgtaatttatgtcgcaacttcaaaaataatataaatactttacattgatattaaaaaaaaaaaattgagctctaatgacctttggagctcatgctcatctatggaaaaaaaaatccatgcaggaagaaccaagaggaaacggtatacaaaataatattaaataaataattatttgtcaataaaataaataaaaactcaccaaagtacataacagttcacacagcatgtttttagaaaagatcatatactattggtttcaaagtctttgactttgaatgtttgaacttttcaaggttcgcctactcgccggtcgtctcctttaaccttcgtctctgtgtttatataagaacatatacgtatttgatgattacaaaaagacaattctttatccttctttagatttctgtggaaagttcactatttattaggagagacaatttcaaaaaggaaagctttttgcttggaactgttctgtgagttcta

SEQ ID NO: 4371 - DNA, 467 bp, Arabidopsis thaliana
taagagtcttgtttttgtttgtttgttgtcctttaagacgatagtactggaccaaccaaacctggtgtgtataaccaaccaacggttctattggttaacggattaatccggttttggtttaatcattgaaagagacccttgaaacgcggtttcacacttgacgatttatcacaaattaggagacgactcatcaaaaaagaatatcttactggtcaaccattttatagaaatattaaaatcaaaaatgatatttaggccaaagtagaaaaagacaagaagagagagaaacaaaaaaaaccttgctcaatacgccaccgtcgtcgtctttaacccaatctaaaagcctctgttcttttttagttttatcctctttttcatttcaagatcaatttcataaaaaagtttccttttttagcgaatcctctgttttagaaatcttaaagttgtctcctttattaaagaccatc

SEQ ID NO: 4372 - DNA, 882 bp, Arabidopsis thaliana
attttctttcctcaattcaattggagcttcctagttaatagacatatatatatcttgagaatttggtactcaagaacactctcggtcatctcctaagcgaacataggcatcatttaggacagttgagagaaggaacagaagctgtcttgtaacggagaaatctttgaaatggagatatgaatattcttactttgttttggaactgctttgtgtattcatatgtgtttgactcacacatttcatcaaaatgcttataaagggtttgattgataactcggactcggttatgggtgtaacgttttaatatttaaaatcgcaaaattggaaccgcttttttaaactgagtgaaatatagcgttttgaaaaaagacgtttctggtggcttctgaattgaaaaatcagcgtttttacttttcacaatattcaattggagaatctttagaacttcaacgaagtagcgtctccggaatttcaggtaaacgtggcaagaaaaagccaaacggagaagcatccacgtgtccctccattagccatctcccacgtgtccattaccgtaccgacgaaacattccttaaccaaaggcttcccgaaaaaggacagagtccacaagcttcggattgttcacaacttcaaagcatcgaaaaggtttaaactttacgtttttctctggaacccgattcgaagaaatcatcaagaagtttcctttcactgatttctcaatctattcgtaggtaacccaattccaaaaaacgtttcttttttctcgatgccttagcttctttggattctgttgtgatctaccgattttgaatttgcttgatcgatcatcggatcactgtgattagtgttattgttcctttcctttgtgtagctttcgcgctt

SEQ ID NO: 4373 - DNA, 2000 bp, Arabidopsis thaliana
ctaatcgacggaagcagtcgtcatcaaacttataactgaattgtattaaaattgcatgcataacaacaataattcatgttttttaacactagcacatacgtcatgtgcgacatgtcgtcaatctggtggatggttagtggttctcctttgttatatttatacgaaacatgttgtttctggcctttgttccaccccttcccccaatgcaacattgggacccgtatataacactctcgccgtatttaatgcaatggatacgtatcaaatattttcctacggactctttatattgtcaaatcgcaaataaaatgtgccgataagattatgtagcaagttggatactaatgattactgttataaccaaacatttcatgtaatgtatgatctctacaagttgatactttcgctaccaattagggctacagtagtttaagatatttttccgcaacagtgcttacaagcttttaagccacataattttgaataattatgatttccctccatactctcgaatggctgctaatctatggaatccgtcgcttgtgtaaatgtcgcatcaaacatataactgaattgtatttgaattacatgcataaccacaataattcatgtgttttaacattatcgtagacgtcatgcgcgacgtgtcgtttatctggtggatgcttagtggttatcttatgttatatttatacgaaacaagttgtttttggaattgttttcaccccttcccccaatgcaacattggaacccgtttataacactttcgccgcatttaatgcaatagatacgtatcaaatatttttctacgggtagatttacattgtcaaatcgcaaataagatttggcgaccatattatgtagcaagttgcatactaatgattactgatatagcgaaacattgcatgtaatgtatgatctctataagttgatactttgtcgagtatattgcccaatacacaatttccaactcacgcccattgttttcataccgcgtctgcatataggaattacatgtgttgtttttaaataacgttctatgttacagttaccaatgatcttttacctgttagtctccattgaataactaatcgcatacaaagcaaacatctgtatatatacgttccgtttttggcatatctagtgatataaattagtgtttaaatatcaattccatctatgaaatctaaaaggtatgtggtttatagaattaaaaaaaaaaatgaacaaatacatctatatatatcgtgtgttttataaataaagcgggttactcattatctacgcatgtttatgttctcatcggtaattgaaatctataagttatgtggctcatcaggaacaaaaacatatataaatggcgtgtgttttataaataaaacgggttactcattacctacgtatgtttatgttccctacatatagacacctagtgtcggaactcacgtgttcccgcctatctttccaggttattttggttatttcacaccccaaaaaaaggctatttattaaagttttctgccgcatggctattttgctaatttgtgtgtcgaatttggctatccagctaattgactctagttagtatatatactctagatttattctatttgtcacattgttgtagttggttttatttgtaagtaaaaaagaaaaacttgaaaagaccagggaagaaccaatctcttaatacatatttcttaagataaaatttcattaaaatacaatacaatagatgtttcattaagtatgtttcgattttcataaaaatactttatagaatttttcttttagaatggatcgtgaatatgacggctctttgacctcttcgcctagttgacttggtaaaagagataatcaatacaatactacaagtgatctttagtggaaaaaatagatttctaattaaagttctgaaagtttattattaaagtatcacaccttctttctatataaatcatcgtttcttaactctacaaaccactacagaaaaaattaaa

SEQ ID NO: 4374 - DNA, 1682 bp, Arabidopsis thaliana
ataaaataaaatattcgttagttttcttatcagaaacgaaaaggtaatgttttaatgatttattttggtattttttggatttttacagcgtcacaggcatgggatgctaagaggtagcaacgatggtaatcctacagaagtattaatgttgaaaacggccagtgaagaagttttgtttttgtaaaactatgcgaaaacaaacgttgtttgcttatttattgccaaagcaacaaggaataatatgatatgaatataatagaagcaagaaccaatttgtttttaatttagaaaagaaaccatatttaatttgtttctttttaaagatgtcattgtcacccttctcttctcagtgtgttatctcaacccgaaaagtcaaatattattttggagtccacgtcattgattagctttggccttagctaatcttaagctagttttggaaagtttgggggtagactggcttattggtcagccacgtgatcctcatacaatgacggactagaaaggagcaaacgagacaattagcccaaggcgacggtattaatgtgataagaacagaagtggaaactcaaacattaagaagaaaacactcataaagaaaaactagttgggagggatttggttcttgagagtccctcgtgctgtcccccaaaacgccactattatattgcagccacttgttgtcccccattcatactcaaaagtggtatccacttgaacatgtagttgacaagatttcatggagtacactggccacacatcagcatgtgtataatgattgggagcaaataattaggagaatatatattgacttttgtttttacaataagtaggagaggatatcaagtgattaagggattggtttacgcatgagagagtttggcatgctaatagaattcaccttaagatatctatactccgttctttggtttctctcctcttttgattctctgtttaccattagtttcatatataatccgatacgacatgctaatttgattgccgacttgcagtggcctatgagaccaaaactccttttattccgtttaacgagagagattgatagaacgaattatatatataacccatacttgaagatgtgattcttcaaaaactaaatagtatcaaaattgtttgaagaaaaatatattatcaaaattggtaaaaaacatattaaaaaaatggcagtactctgtagacagagactctccacaaccattattaacccaacacgtcacatgcatggaacttggcagcaaccatacactttcactaatgagtcattaccgctattagtagccattggtttcttgttagacaagaaatcatataatatacgattaaaattgaatataaacaaaatctttcgtaagcaattggatattctataggatacgtgagctgaatattcaactttgatataaatgaagttgaatatgtgtctcttggtccttgctttcgcattcatattacacacttgtgtgttgacaaaataaaatgcaaaattttgccccaactaagactttttctcgtttagcaaaaaacaaaaactaagacttttctctttcgtaagatattattcatagatttctcattttcaaagttgaattacgtaagaaagtaaatatactttttcaataaatagacaacaaaccatctctgtttttcacagcaactcgaaa

SEQ ID NO: 4375 - DNA, 2000 bp, Arabidopsis thaliana
caaattaccgtttaatcctcttagtgggacggtgtggtttgattttttcactttttggttgttattattatatttcagatttcttttatttttactgctagtagtaattgtggtagcttctttttatggaaaaaaactgtcagtgaaaattgtaataatgaacattattacagttttgtcttctttctccacagctccactactgtggcgtggaagatcgggcatatctctttcagtcatcatcgggattttcggaattatttatttattcttctgtttttattgaattgatgtaattaaaaaggtttaaatatatagacacagctatttttcgcaggaaaattagtgatgtttgtgctaataagagtggaccacgtagcaggagggaagttgatctttttactccttcgttgttgaattgcaattgaatttgctttttatatgttgttagacgatcgattaaaaatgtataaaagagattgcacagtccacttagtttcgcgtcttggtaaattcgggaattggattgtttcgttttttttttttttgtcggccaaagttattaatgtaaaagcccaattggcagtataatgatggaaataaaagcccacatttctccgttcatatatttgtattgttttttttttttgttttgtgtggatccccagtattacggatttggttgggatttgggaagtatttgtaatttgtatcttgaaatctttgtcgtggcctctttggttacttgtcttatttcaatcggtcaatgaaataattaacaaaaacaaattgattagaaaactcattagtactcgaaacatatatttgtagaacttaagtgagttataagagctacaatgtcgaaactaaaaaactttggtgaaatataaacacatgagctagctataatatacaaactgtatgtccgtgtacatgagatagtcagtggtgaggggaaataatccaaattttgttttgatatgaatccgatagtcgtttttgcacatcttatagggacatgatcagacatgatgttgagttctttaagctgtcaaaacaaagatataatgttttgtttgtaatcttaatataaaaccaaaatctttcaatgaaacttcacattatctactttacgctatataactatacaactatatatatatatatatatatatatatatatgcgtttaaatttcacagtatcttcttatatgcgtttcctaatctctctacaaaactaggatattcttccgtgacaagtaagtagtaacagcctctctctttcaatgatcagtctattaacatctatatattgatatggtcatgttttatcgcttaacgaatcaagcaacccaaaaccaccaaaaattcacatttgacatttgtcaaagactctcaatgtcaactctaaaactcatgcaaataaaataatcaaatattctcaaaatcatcaggtatagttcatgaaaacctgagaaacaatcatattattgaataaaccctcttgcagtataagtaacttatataactctatcaatgccgacacttaacattttaaatttcaagtgcctcctttttcagttgaagatcttttgtgtgtttaattaagatactactaacgtaaacatggtaacaagataatgttttaaataactccttacataatacgacttgatgcaacacggtttagttaaaggtttaccatttcaaacttcgagataatgaaagctacacttaacaatggtaacaatacaataatttaaataattctcaatataatatgacctgagggaacacggtttcaacagcattttaccgtttcaaacttatagacaatgaaaattacattggaatatacatacatatggacttgttcaaaccgaaaatcatctataaattgaactctttgtctcataaatttatcacatcttcattgacaccacaaataagaaactaacaaaaacctttttgtcttctacaaatcgtctccatacatacat

SEQ ID NO: 4376 - DNA, 2000 bp, Arabidopsis thaliana
tatcttatatcgatgacactaacgaatctgctcttgatttaatgaagagtaacataaaaatattatgaatatataaagaggaagtgaacaaaagatatatataaagaagacatataactaacataaagaacaaaggagtctttcgaaatgtttacgtttggctgtccatcgttttggaatctatgcctttttattaaatttttttgtcgaaaacctttttattaatataaagtgttgattagtgtaaccacctaatttgaacacctacacgtaaaatatgtatttatatgattaattatatttagtgatgaggatgactggtggattatagacactctgcatgggtatacagataaagaccctttggtgtccatttcatgcttagttgtcatttttattcatttggctttcatccactcaaaatgacaaatctaccctttgatatacacgtacctaaacataagagtagtataccaactatttttttttataagctaatattactctctgtccttgtttttttatcacatgctaattccactataattggaaatgaacagctaaaaagaaataaaaccagttaaagacttatttttccaaatgcctatacacgtaatctactaaacacgagtttaaaattttcaaattacataaaattaaggtaattttcttaggaacacttaaataccttctcttttgacattataaatgacgggggtaaaatgttggttaggcttcccaattgtttgtcaccatcatcaatctcgtgcagtccgtttgtaaaactttgcagtgtatgtatcttatgatcatatatgaaatttatgactagctagcttaacgcttcaatctttgagtgcaagggagaaaagcctctccattattggctgacatcaataagaaaacatctcattttctttcaaactaaatgattttaaaccggagaagaattcgttaaacatacaatttttgaaattgaacactttgatactaagttagggcatccggtgaaagggctcccaaatatacaatttttgaaccttgtgcctcaaaccatactaaactctctaacttcacgtggtcggctacatcaaatgaaggacgatcgaaagcctagatgttttattgtttcaaactttctagatcgactaaatgtcacaagagaatttttttttttttttttggtaagggatctttcccatatttgagcaaattgatgtcgtcgggaaattagacaggttatctaattttttttatagtgttaaataggcaatttagttattaaatttatatacctttactatgtcagtttttacatatcttaaaatgtattttcaaatttactagtaatcatagtaaatgacgtggtaattttgatatttttatatcgctatttatacgatttggattagattttgttagataaagaaatagtctagctattctaatatacagttgctttaactcaatatttctttaccttagttaatttatatatttttggaagatatttggtccagttgttaatcaaaaatttatttaatgtctttgcattatgttaaaggtttgtttcctaaaaattgcaaatcatactataaatattgcatgaaattcaaatcatgaactgctaaaagtaatcataatgaaatttttagtcgagttctctgatcattcttttttttttaaatccacattggtttgatttttcttgatcgatcatctttaacatcactaatatacaataaacagctgcaaaaccgtggcagactaattaaaaaaaagaaagggtaaagctggaaaatattgacaaagaggacaaatcagaaaagactattgaataatttactctcccttatataaacaccacgagcgtggaagccaaagagcaattttctcccccacaccaaaagataaacctctctctctctatctatcttatgtcaaaagacagatttattaacaaacacaaatcataaatctttttcttcttccgagaaaga

SEQ ID NO: 4377 - DNA, 2000 bp, Arabidopsis thaliana
acatatactggcttgatgaaacaagtgttttcaaggtgtggaatcgcatggagttgggagggaagatcgatttcaaactctcccaattcatcagtaacagccttaatccatttggacctccttttggatccagtgtggcacttgatggcaacggtggcacctgcgaggatcatgttagtatatattcggacggaagacaagaaacatgaagaaaaaaggtagagaaacaaatacctgggatagggatggagtgaaggtgaggacgtgaagtgtcgcagagaagagatccggtgatcacgacagaggagagtttctgttcaccgtagccagccatctccaccatttccgttctggtccataaattattcccaaatgctccggtgaacaagaagaaagagagtaacaagaagcaacggatgatgaagaagcttcccatcgttaaaaacaaagaaaagaggtttgtttgtttttctttgtattttgttaaagaaatgaaaatagcatgaatatatagagaagaagaaggaagctaaagaagaggaagagaccctttgcgtggtggcttcaggtcacacagctctgtacggcagtgtctctctttataccttgtagtagcctttttcttttcagttgtatcttttctaaatatattaaaaatcgtggctgacttgttagggtcaaatttagagctgaatcttccaaatgaaacaatgaaccgagagcgaaagagaaagagagatacggcacttggaagcaattactgagtggttcgcctactctttcactccttgtataagtattattttaataataatatttggtgcaacgtttttgtatctagtgtgacgtttctccttttctttatttaattaagccaattcagttagagtagtcatgcagtaaccaaaagattcaagcctaccctcaactatactcgcacacattcagctttgaacacaacggcttcaacatcgtgggtttggtcgtgtctacgtgctcagaatatctagttgatggtgggagtcagcagggttttgaccaaaccacagtttctcaagtcctcattacattgaaaaaagtatgggcttaaaagaagcctagatattgataataggtccatcacctttaatgggccattcagtttgattatcttaacggcccattaggattctccaggtgggacaagtattagctatgtcattaagagcttaatacagctggaagctggtgattattgttaatgttaactaatcacacgcttagaaaagcgacaatggttggacccacaggagaagatcgagaccgtcaaaagtggacaaaactgggacgctttttgtttccaaacagctgtctgatctgattggtcgatgcagttttgatggcaatgaaccccaccacagaccacaccctcatgatccaacccaattcgctcgtaacacaaaaaaaaaaagaagtgaaaaattgaccgaagggtcgttgagtggcagttaccctctgtctccctaacgcccacctatcttctccgtgttttccacgcgctatctttctctcttctgtgtgtttaccacgctcctcttatgcgcgtcggctcgtgacaaaagtgtgccgggtccactaactgtccacaacacgtggcaaagccttaaagggctgtctatctctcaaacaagatcaattccaatccgacggtcgagcacgtatccagttgtcagaatcttatcagtaaacggacggttcatataagatcacgtgtcaagtgagcagaagtcgtgcgtcctctctttatataagctccggcgactccttcaccactgtgtacaataccagccgacacttaacaattcacacctgctctttttactctttctaaaaccctaaattttctcgcttcagtcttcccactcaagtcaaccaccaattgaattcgatttcgaatcattgatggaaatgatttgaaaaaagagtaaagtttatttttttattccttgtaattttcagaa

SEQ ID NO: 4378 - DNA, 1583 bp, Arabidopsis thaliana
aaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatg

SEQ ID NO: 4379 - DNA, 2000 bp, Arabidopsis thaliana
cggcatagactaatagtatgatgtaatttatttgtacaattttgatttttgatttttatttatattaattaataagtaaaaaaggataatttttaatttagtaatataatgatagaggatattatatttagtgtgatttttggtgttgtggttagagaagggaaaaaaattaatgctaaatttacaccaaataaagtgttatttcaacactaaaatagtgttagggtgatgcccttatcaaagaggtaccactttgaatagttttgacagttatcaaccacaaaagttttatcaaatacggtacaaatttttttactcttacctttttttgtacaattttctcttacaaatcttttatacaattttgtactattctgaaaaagcttacaactccagttaaccgcttaaatttctggacaattttgtgttatgaatcgaacctagtattcattgctcataagtatcgaaagtaaattaaattgtagatcaactagcaaaacatactgtattaagggaaaaaactttcgattttgttgaagttatataacatagattgtgcaaaatacaattaatcaaagccatcaattttgagattccttagaagtgagattccctatcatattttgatcttatttttctactgttcaaaaaattaggtcttatttcatatctttaaaaaactttataccagtcctgatttaaaagtataaatgagaaaaaattgtataaaaaagattatctaacacggatttatttattatattattatgtaatggctagatgctagatcgaatcgcgttagttatgactcctttacatattttcgatggctgtagcatgatgtcaatcttagcctatctagtagttatgtgatgcgtcacatatgttaaaagtatgtatgtcagacatgatcaaggtctaaaggtggaaattgctctatcatatgtggtagaagaaaggaattaaaatagtttgatgaatcatttgacatacgagtaaaacatttttaagaatttaagaacttgttaactatgatatttttcaataaaaattaacttaatacaaatagtttatatattaaaagagagtcattgttgttatgtggcaagtccataattttgttcatcaacatctttttttcatttttggattcattatatacttctttttaccaaagacatttattcaaatatttagtcttatatataaatatttattctctattcctatcaaaaaataaaaatatttattctgtattaagtgcattgagtatttcaattgaaaaaaaaaatatttctttcctaaattatataattgtatacatatttttcctataaatagaggtatcatttaacacacacatcatttttccctagattgttttttttttaaataactattttattaatttcgatatgcaatcaaatttctaagaatccaaagttacgaaatttagttacatattcgaatacaaaaactactaaaaatgtatgtatcaaaacatccattttcttatagtttccaaatattgatattgcttaagtcaaagacaatcacagtttctcaatcaaagccacaattcactgctttcaaccttttttaaaaaactatctcacgcgctttaattcgcactctcctctctctttcttcttcctctgtcctaaaaaccataaatgacaataaataaagagtttagtcattttatcgtaaaaccaaaagaaagagaaaaagattaatcatcatcaatctaaagatttaggaatctacaatttcccagtagacagatttcacttttgcgtcttcttcttattccatttgatctaagtttctcgaaataggtacaaagttcgagtctttttcttgtaaccgcgtgaaaccaccaagaaacctatagtaagagtttccgcaaatgtgaattaaagacagctcatcactctgtcaaacttctacagtattaagttaacgaagcaggtacagccaaactaaaataacgcggagtt

SEQ ID NO: 4380 - DNA, 2000 bp, Arabidopsis thaliana
caggcttgagaatggtcatgtcgcgttctgtttgtttgtcatgaattctcagtgttctcttaaatcaaatctctcacactatgagtatatgaacaaaatcatatacaatatcacaattccattatggatattctcccaatctatctctcatacatgaaaatgttctatttcgatcttgtatttaaataatgttaatactctgttttaatttgtgtatcctgatttttttttctttttgaagttcaacaaatatatcaaaataactcagaaccattactattttttcttagttcatcaattctttactacacatagaaacgtatttatcttgtttgatctactttgactctatatatgtcatgtggcatctctggtcattgctagtcacaggtaaaagtaaaaattgatcaaagataaagagtctttcatggtaaaaattctcttgtaactggtggagatagtagatgtcaattcgtttgcaataacttacatttgcaataacatgtcagccatatttatttaaatttccatgcatttgatattattttctctctaatacatatatgatgtgttacggtcattctaaaaatccagttgacagcataatgaagctggtacaccatacatgcacttgattatatatggatgttactgccatgattgatgttttgatggaattagtgttaaaggatggaccctcactaacgcggttggaaattatgatcaaactcttcaatgtcacttatcaagagagctaatgactagcacgtttagttgttctgttgtttcttatggctgcttaatgtctccatcaaatatttagacattgtggctagtaaaatgccatctaccttaatcctatatataagtataactagataataatccatatttttgctgggtttagtagctgatacgacgtttatggttgttattgagtttgaatacaaaatatagagtattgttggagttatattgatttttgttcatattagttaacaaataataaaaaaattaagaaaggtttttgaaaatgcatcttctagaatatatgtatattcgaaaaagtcacatctttaattgacatatgttttgtttgtttgttttttttactggccacacaaattgacaacaatggtcatgcatgaaatgaaatgtttgttgtcaattttttttactaacttgtaatatcattatgaaatgaaatagaaggtatatattacaaaatattacctaaaagtagagcaatcttagaaaaaaaaaaaaaaaaaaaaaaaaaagaaaaagaaaaagaaacaagattacaatgcatttaaaaagagatggaaagaatccgagctatcgaatccaaagaagcatcagcttcctccatctgttcttgtatcgtctaccagagatggtgttccggatctctcgatcaatattcttaaagatggttgttggagggatcctttggctattatggagaacattattcgtttatctccagatgtgatagacaaagggctgtgtggcctgtgagaccgatggccacttaattattggttttttgtcaatggttgtgtatgcatagaaattcccacaaccgtttgtggcttaacacaatttaccaggggtttaagtggttaaattgatacatgtagatctaaagttttatgctaatataaattagttttaattatataaattttaactacgctcatgacacgtaaatggtagaccaatatgtggtgctctattaactaaggggtcttcattattaattcataaagactttctttactatacaagacttgtcaaaaggaaaagtagtattttcgtactacgtctacccctctcacggatatgtgtggtcgagcagtcattatcataatgtggaattttgaattgagcgaggtttcaaagttcaaaactatcacaactagtcttgatcaattctatataagatctgtgatcttggttgaagaaaagaatcgtcgtaggttgatatttaacaagga

SEQ ID NO: 4381 - DNA, 2000 bp, Arabidopsis thaliana
agttttcgtaacacgccaatagagaaaatatatgaatatgtgttcagtttttagggtttaaagttttgacggcttagtttccggaaaataaaatcatgccgacctttgtatttaacttttgttgtataatttttcagacaaaaacaaaactcatcaatatcttttcattttcccttagtctgttatttttttgtacttagagaaatgctatctttgccaaaaaaaaaaaaaaaaaaaaagagtaatgctatatgtaataaacagcttggccaaaagagtgtgtaataaacagagtttaaatagaaaaccttataatctctccgagaaaacatatcaaagctacaccaatcaccaatgtctccttagtaataataatcatacatatacaaaagcttatgcatgtgacgttagtttatcggatgggtaccataaccactgcaccgatcacgctatccattttagtgacaattacaacttttagcaaattccaacactcaaccgcgttatacaagttctgagaaaaaagaaaaaaatcgtccaacagaaataaacatttaataaacaaactcgtgattggaaaataaataaataaaaactcgtgatatcaccaaatttcatcggcaacgggcaaattgcaataaatcaaattaaaaatggttttgcagttttcacggtcaacctatacgccgaaactcggcaagaaaaacaccgacttgaccacttaaccacctctcccttaaatttattttttcatcattacacaactgcttcttcttttcttctttgtatgattattgttaatataagcatgattagttacgaaataatgtcacctcataataaattattagatgtctttattttgaagacttttgcttttgtttgcttctgtagaatctcttaaaaacgaatttcaacatcaaagaacaaaagagaagctctccaaaagctggcattatccttttcttcctttacctcctaatctttgcgcgttttttgttataaccacttttatataaacatgcaaacttattttttattagtattttgttaatcgaagaatgtcacataaatccgagttgtttttgctatttaaaatatctacaaatggtttaaggaaagcatctatcaatattaataagtcgtacataatacattaaatttaggcaatctcttacaactttcgtaacaatattaatggaatatcatatgtgctgtagatgattgggatgtatgagaaaagtaaacaaagtgaggccacaagacctttcggtgaagacatcttctttttttttttgcatagaatcaacttgattaatacgtcctaatttaggtgaaatatattcatacaactaatcacatgcatttcataataatatagaaaaccccattccttagacaaaagaaggtcaaaacgatatacaaaaatagttcaatcgaaaccaaaataaagcaaaatttatgaatacatgttaaaattatataaatcattctgaagtaactataatactaggttaatacttatgtttgtatatacaataagttgtttttctaaaaccgaaatcatgtcaaaccgaaccaaattgcaaagtttttgtaaacccaaaataccgaataaattacaccgaaaccaaaccgtaaaccggattgtcttcacctaaattacttatattataaatactacaaagagattatatgggaataggtaaaggataattaatttgataattataatttttgaaagaacaaattttgagaaaaaaaaaaaagataggcttgagagctgtgaatgagctgtctctctttcatttatattccaacctctttctccttccacacaaacataacacaaaacctccttctcttcctcatatctccatatcccaaaaatactcttataacattgtattattatacaatctacatttcccattttaccctcgcttctccttccaattctcaccccattgccacttcactcagatgtcttgtacactgac

SEQ ID NO: 4382 - DNA, 2000 bp, Arabidopsis thaliana
gtgctttatcacttatgagtttcacttttaaatcagtcacttaacaaaaaccggacgtgacaatatattatgtccagatattaatttgggattagcctataacatccaatcattcccaagagcaatgatataattttgtagttttttatttactatttagtgcgcacctttcttgaaccaagactccattcagtgacaggattagataagtatgtgtgtattattgaaatgtcgtcgagagtccacttgaagtttgaactatgacgacaagaattattccttttctcttctttctattcagatggagagaagctcacctcaagatttttaaaacggcactcaattacgacttattttgagaaataattaataaaatttataaattattacgtgctctattttataatttttctcttttttataggttttaagacatgaaacactgcttctatgttttttttttggtaatcaacactgcttctatgtttggtgaagacatcttgcaaatgacattacataaatcatagaaattagtttcgatgttattctaattaaatcctaaaatatggacaaaaaagagtgattctattgttcaaaaagaaaaagaagagtgattctaaaattataagctaaatatcgattttagaatgtacaagttgttcctacaaattgctaaatattcttttaagagtgtcccattcatataaaatgtaagatttttgttaataaactaataaccagtggataagggattttgtcttttcgaacaaaaacgaatggtgagcactaagaaaagagcgaagtgactctatattcattccaccatattccccaagaatacaattggtcaagaacttcacaatcacaaattcacgatcgctatgtcatccttttaatattgctatcatccctctaatttactttccattttttaagatcatgaaatttgaaatgtcacatatacatccgttgtaacttttttctagtcagaaaaaaaaacgactcgtgtttaccaatttggaacagaatcacacatttagaaggtaaattttggatcgaaaaaactttgcattttgttgaaactcccatgcaacttcacagttccaacaaatatctttagagattaatatatagcattagaaaaccaactaaattttgcgaaattacacatctaaaattcgcttgagagactatttacttaccaaaaatcatagagattaacgatattatttgtgtattcacattataggagattgagagataatgttattaacgttattaaactattaaattaacaaaaacgtttttgttcagcgaacgggaaggaagagggaaatagtttacgttaccactagtttatgttgaaacagttttggccgaaaaataggccatcattaccactataggccattccgaaatagtttacgttgtgaaagtaatatcgtgccttatttagtacaaagttgcccactaaacttacgaaatcgaatattccatagttacaaaggttaaaaaacatataaaatcatttacaaccaagtcccaaagtttttgtgctagagaaatatttattatttaggcttatttggtggtagataaccaaaattaggtttatttggtagatagccagaattttgaggtttacttgcaaaatatgataaattataaataatgagatgttaatttcgcggatttttcttacaaataacttaataatataaatatttttatttatttaagtgttaaataatacaataatttttgttttgtttttccgcctagtaaataacgacgtacgttaaaatatttaagagttcagtaagaaaggggaagaaagcgtgacacaatgttgtgaatctcgtgattatataagtggagttttgtccatttgtcaaacactatctatatatgttttgataatttcatagtcgcttttaaagagcatcaacaacaaccacacgcttctcaaacatcaaaccaagcctctctttcacttcctc

SEQ ID NO: 4383 - DNA, 1649 bp, Arabidopsis thaliana
acccgcaacaagtctcacacaatgtttaagctcaatttccgacaaaattgttagtatacatatacttatagaccaagtggattggatatcgttagttagtcacattcttttctttatgattaagccaaacgcaagcttgactaaactaatcattctctacttttactaaacacagcttgcgctccagcccccacccatttgttgagttcaaactcgaaatctttcttgtcttccctacataatgtatatatcatgtaaatttgttaccaattctttgattctttcagtaatcaacaagtgcttataaactcaataacaaggtgtttgcgtaataaatatattaaaaataattttactacttttaacttcaaaattaaaatggcatccttatgaagggctcttccttgtcaaacttgttcatgcctttttcttatcaatctgttctcggagcattttctctgcgagttttctctttgaagtctcttccctaccaccttgctaaaagattcctctccacttgtttgttcctagtaaatcttgtactgtataataaggtctctctcggatgtcctcttccaccgtttctctcccaaaattttctccctacaacttttttttaagaacaagtgtgaatcaagtccaaaaaagttgatctttatatcatctttttaaaaactcctcttaaaatgttatttatttaatgtttattaaatataatatatttctcttttttatttttttaattttatttttgaataacaggaggttctggaccgaagtccgtaatccctctagacccgaaaccacataatgtaatattagtttcgtctcaagcgtcactcgaactggcgacctctaaggttcgcctaaaatctttaccaattgagctaacgacacttaatttatttttttaataatcacaactcctttgcatatatatttatttttagttataaaaaaatctttttattttattgttaaagaaaaataattttattgttgcaaattgtagatttgtcaaagattcattagatttgtcactaaatataatacccaaccaaaatgatatctaaaagaattaatgaaacgtgagtatatttgttttcaacgactaaagaaacatataaacaaaacttataaaaatatgaaattgtttttgataatttcaaatgacaaaataaaaaactacaaacaattttcatctctaagatttcatttttttcaccaaataaaacctacgaatatgagttcttaaacaataaaataaaatcaccacactctttaaaaaaaaagaaacttatacgaaaataagacttattctcttgaataagtaacaaatccaatagtttataacagaaactccaggtcatctttctttaaatataaacagattccattttttgcattatacacccttccactctcacgtatatatatttcttactttacccttactatttaatataattccatgtttacccttcatcttccctctaaaatccaacacagagagatttcaacgctaaataaagagagagagagtctaaaagctcgtcgtcgtcttcaatggtgaatctcaaaccaattggataaataaaacaaaacaaaaaaaacttcacaaaaaaaaaaaaaagatccaaattacaacc

SEQ ID NO: 4384 - DNA, 1899 bp, Arabidopsis thaliana
gtgattctatttatcgttattaagttatgatacgaattaagaagatagagacgtatagactggttttatatatcgactatcgtactttaatttggtcggtccaaatatgtacaactaatctatccgttctctatgtattgttctcttttaagatttcttgttttttttttctttggttgttatgatgcttaattcctctcgtcaactgtttaagaataagatttgatgcgtggtagtggacttgttttcacacttcgtatatatatgaccttgtttacttttctacaaagaagttttatcacacatatttagacagggaaaacaagaggaatatatataaatgtaaaacttgccttcgtgtagaagagaaaatgattttcttaatttgatccgtaaaaatgaaggcaagtaaactggagtgcttgtacttgtagcatttaaacaaactcgagtgtgcaataattccacaagcatgttactttaaagatgggaagatgatatttagcagatcgatcttgcgcgtgagatgacgtaactgttctcggtaagatttgtctttacatgaaacagcttgagaagcccatatctaaatatctctttaatcgtgtgccaatcaattttcttatgtttggtttgtctatatagatatatgaccattgtattaatcatcacaaacagaacagttggaagtagatatattaattcatacccaaatctttcaacaaatttttaagtccaacaaaatgtcaatatcacaagttgcaattgatacctaggatttttcattaatcaatataaaaaccaaaaacaatctgtaaaccctacagcctaaatattgtatttattatcaaaacctatataaaaccctcaagtcataaaaccttaattaatattattaaataaatataaatagatttgaatcaagatcacgtcatgtttgtttgattttatttcgcttcatatcattgaagaaaatcataaaaccacatgagatgaatatcttcgacaacgaatacaatcagcgtaatatacggcttggatgatatgactatagatctttcagtatctatttaaagaaaaaatgacgaaccaaaataaacttcattcgtttgttaattaagagattattattttttcttagataaacgaaagtcggtggatagaaaaatattaaatgctcaaattattatggttggtttagtcttctgaattcgtagaaaattgagatgagctaagcaaaaatgttctttatcctcgtgagctgctccaagaagtggttgatgatgtaatggacaaactcgtttcgtggatcttatcattctaggctatggaccaatatggtgcagtcgacacgttcggggctttgtctgcattttgtggtctcgttattctgagttgtgatcatcattaataagtgagttgtaatgcattacaaaatcggtttgtagttattcatcctttccaaatcaaaagtgacatattgacaattttgaggcaagctttttgtttttataataatactaattagattacataatcttcaatttatattatttttaaaattagaaaagagcatttttaaagcaaaaattacattgaatcataaagaaatattggtttaatttatagagatgaacatgttgataattgaaacaaatttatttaattattttttgtatgcactcaactctgtttggcttcaatcatataagtataaaatataattaaaatgtttttattaaaatattagatttcatgattcttgttttagtatataaaaaaaattgatatctccatatcgctagtgaatagtgcagtatctctttacgcgctatttcaagaccaaaccttttctctcttctagagtgaaactgtggaagcaactctcacagagcagca

SEQ ID NO: 4385 - DNA, 880 bp, Arabidopsis thaliana
cttcttggttgttctgtgaaatgtcttaattaattaagattgtaagcttgtagaatacttgaagggatttgatatgcattataatggtatttatataattagaaagtgtatattttagtaaaatcctaaatctaagcattacactaacacgtggaaaataacataccattgacgattgacatggctaattttttgtggaggtgaatagtttgaggatttattaccctaacgttgcttggtcaagaagtgaagtaggatgacaggcaataggaagatcttaaacctttttttccggtgacaattatttatgactttttattgttgtcaaaaaatatattatcagtaatatatcaataacgaatacaataaaaactcatccgatcgattttcaagaatttatagctatattaaaattacttcgaatccatgtaagaattgtgtattggttctttttagaaaaaagtaaatatctatgcagtaatggcggttgcataatatatgccttgagtagatgaatatccaatatcaagataacgtgagtcaccacgtgtctaacatcttccgtagctccgtttttaccatgacgtgtcacatagatataggtcatcatgaaaacgagaaacctaactttaacactcgcacataactccaagtttcgaaacttcgtcacatcaacctaatcggggcacgtacctacacacctgtcgcgaaactgcaacacctatcttgttctctcgccgaccaagacttgctataaataactctgactaacgagtcggagacaactcacagttccaaacacacaaaaaacacaagatctaaaaaaaaaagcttttatcatttagaaaaatttggtttcgaatttcttcgaagagtgaaa

SEQ ID NO: 4386 - DNA, 2000 bp, Arabidopsis thaliana
tttaaaactcattttcccttgccttaatcttgtctgcaatgtagggtattgatgtcttgaacggcatagtgacaagcaacgcctatttggtaataaatctcgctatgcatgcgttttcgagtggtgttgactattttgctgacaaggaggatgttagctattgtgatttagtgccaccagctgaaccccttttaagtataatgaaggaaataccaccgctgagataagggtgttcaatggagaagatgcaaactgcacgaccctaggaacgtgaggcaaagagacgaaagtttggcgctcttgttccagaggaccagtttctagctcaaaatccggtaatgtttttgttttccttccttgtgactagactcgtgtatctaactagcagtaatacattttcagggtccctttaggatcatgatcagagtttctggtgcagacgactatgtggagtctttgaaatcacggtggactcgttatcacacagacagatgttaagtggaaagctggggttttagaggacaacaagtcattgcacattacaatgttggagcaggagaaattctaacagtgtcttggtgacaaggtttttgtgcacattagcaatagtccggtcattctttaatgcaaaccataatctatattcatcccaaaatctcagaatccaaagcgcaagagaatcaaacgtttcatcatcttatatctacaacggcctttagcagaagagtgtaattgaaggtccatgacccaagttgcagtatccatatcacaatttgaggtccaaaaaaagaaaaaaaaaataataattctataaaagaaccaaaaaacaaagatactaggaggatttgtcatagtgaatagtgatgtgacacgtagagaaagcccatatggcatcatcagcctcataaatgggtgtaacttgtaaggaacttgttgcgttcgtttctggtttggagcctaactttttgtttctttgtctttcaccatcgctgtttctgtgattttacgtttatgccattttaagttaaggacttagtccagacatcttagaattacatcattattcatcacgatatcgaaaattatacaaatgacgtttagaacaaacggatataaacaatacaaaatcacacgcaatacacggaactatgacaaccatgccacaagtctccacatgtactcatgtagtgatgatgtagcgtcctaaacatatccacattccttaaaatgaaaaaatctactttttagaaaacgaatccaaaacaatagacagtaaatgaatctagtagaatttctacataagtttactttctctatatatcttatattttataacaacaataatgtttataaatttgtttcaccttaattatggtttacaaaatactgtatcttggatttaattaaaaaagataaatcatttataaactaaattgatgtgattcatactaaaatactaaagtgttcttaagatattgttagctttgtagacaagtgagaagaataaaaaaaggcttttgtatggtttaagtcttatagtaaatgctaatttggtttataaaacatatttatactaaaaatctagaaattaataaattaaacataactgagcttatgtgaaaaaggtaagcaaatacatttttggtcaaagaaaagatggaaaaaaatccaaaaaagaaaacaaatattatcaaaaaataagaaagtaacccattttgagtgggggtaataatgtaaatgtgatataagggtggggtaggattagtcgctaaaaaaacttgagggcaattttagtcacacgaaactaaaccatccttcacttgtttaatttaattttgaaaaggcaaaaaaaagagcacttacttttacccaaaaacaaaaaaatcgtggcctcacttgcatttaaatccatccacaccacatctctctctctgtctatctatctctctcgctcgcataaaaggttaacctcaaaacaagtagctcctccttccattagg

SEQ ID NO: 4387 - DNA, 2000 bp, Arabidopsis thaliana
cgacaaccttatagatccaacggtcataatccaacgggcgtcattcttggcgcgttttttggtccccaataacttcctttaattctttcttagacccgttacgttatcattaacaacactttttgtttactgattctagaaagattacggcaattctattagtcgaaataaaacactgcaattagattaaaaaaaatctcggataaaaaaacaagtatgttgctttgtttggagccctgaactctggctcaaatgtttaacgtggtgtgtttgtaacactttgatccattgactatgagttatcggaaaagaagatctgttgaacaaaaggcaattgataggttttttaggacttgtgttttaccttttacggataagataaaatgaattgattataagaagtttgaaatacgaagaagaccggcaaagtaaagaactaaagataaccaaacaaatggggacaggaacaaaacatcaacaattataacaacgcgtttttgacattacttcatttttaatttatcagaaaagcgatgtatatgtttaactacacacacctctaccttcttcacgcgttttctgcaatttctttacttttttgttatttaaagactacgattgtctttttttccacactaattcaatctctttttcattttaaattaaatctatatatacatttttgcagttattttgtgaaataaatcctatagttgagacttatttacaatagatatatacattttttcagttattttgtgaaataaatcttatagttgagacttatttacaatggctgccattagcttttaattattgatttttttctatcaataaattaattaacaaactaaaaatattccaaatatattcagcaactatttaaaacaaaaaatgtttgacaaacaaaaatataattgcaatcccttaaaatgaacaaaacacacctaaatacattctttatctatccaataaatcttttttctccaaaatttgaactagattttgacaactatttaaaacaaatatttgtttgacaaaccaaaatacaattgcaatcccgtaaaatatttattttcattatatatttaaattagcggtgtaccgcggttttttttacgggacggatttggcgagacgggtttgataggacgtcacttaataacaattgtaaactataaaataaaaataaatagatttaatttgtaaacttttatatatactaatttaaaaaataagttgtccccgcagtataccgcgggttaaaatctagttgtacatatttatccttcatttatcatggttcatacacttaaatggattctgtaaatcacggctttttctacgtttaacttgtattaggtgagatcctttggatcttaattcgtcatataaagattattcatttagagatgtacatttataagatttaagaacataatatgtaaataagtatagtgttcaaatgtaaatatgtgtatatatttttgctcagtgtaaaatctaatttttaaatgtgattattgttgaatagaagaagactacaaatatttttagaaaagtcatgtttctctataaaatcgttgttttcttctttgtaacgttccattttaatttactttctccaaaaagtaaaggattaaaaattagattcaacggttgtataggcgtgaaaaagaaaaaataatttccggaaaaatatactatttaataattataataaattctctctctctcctctataaagacaaacaatctccaagtttctctgtatcaacaaagctctgtttcaagctctctgtttctcagatcttctctctgtttttttcttctcataaaataagagttgtgattcaacagttatggtgagaatattccttctctacaatatactaaattcgtttcttctctctttagtaccaaagaagctacgaactcttttccctctttcttggttcgacaaaactctccacaagaactcaccaccgtctccgtcaacg

SEQ ID NO: 4388 - DNA, 2000 bp, Arabidopsis thaliana
ttataatcatagttggggatttaataattttaggtggaataatattttatgcatattggagatttatttctcgagaaatattcacaaacaaacaaacaaccggcttttgcacaaaaataataatgacatggagtcgagttgtttatactaatgtttgtcactatctcaccattggaatttaaatcttggatatataatacatgttttgacaaaaaaaaaagttggcacaaattatgttgttgtaacaaaatacgtctgatgcattgatttgagattgactctttgaacccaaaaatgtatcaccgtaatattaatacattttccacatcaacttgtaatctatttgtgttcagtaatatattggtgagtgattatgtcacctaacccgaaagcttataagatgagcaatctttatatcgaggatggtgcaaaaaatagcaaattgtaactttttgtccttcttattctataaaatgtcagatataattagtactgcaaattgctcgcttattcgtattaatcttaacaactagggctacttgggaatatgtatagttgttggaaaaactaatgcattagataaccctttattatttttcccaattgtgttttgttattatgcccaccactcaaatccaagagtccaatatattcatatgatttgaatatacgtttgtggaagaaaacacacccaagaaatattgtccaattcgtaaatttccctgactttacgttggttacttttagcaaactgcttagtttgattttcttctaattcgtcttattaatattctgttcttttctttgttgaaaaggaatttgattaatactttttttagtatcgtcgaaaggctcaagttgattacaagatgaggaaagattattatgatggacccatgacatgatatcttcaccaacttggaacattgaaagtcctatggagttatttttgaaatttttaccttagtcagaaggttccaacaaaattaaaaatccaccaaaaacgcatccaagaatagtaccaactgaaaatagatcggcaatcacaaagacaaaggtcggtcctcccaaccaatttgtttcaagaattttttcaaacctatgcataaattaagtatagctcttaaccaatatatatagcttaaccaactcgacacatagtgatcatgttcttataatctttaataacgttttagagttagctatatatatagcctcgagacagtagaagattgaaatatctatgcaaaacctcaaagataatgttcaatgtttttatattctgaatattgatataatcggtgagatagagatgagttcagaatttttttctcggtatcttaaatgatattgatttcattttctcaactttcattcaagagtgtttttggttaaaacataaaaacgtccattctaattatagtaatgcttgtgtggttacgacaacatgctcattcattgtaataaactggtgaaatatatagcaccattgacaaatagacagcctcagtaacaaagcaaggaaaaacaaaattaaaatttaataaccggttatattaaatatcgagaaccagtccgtagaatttcatgggaaaccgggccggtccttgatataaagaaagagagagacgtttcttaactgaagcagtacacaaactccaaacaaatcccaagtggacaaccgaagaacccacacaaactaactctctttcctaatccacatacttgcatttttatatataaacactctgtccttatatagttctgtatattacatgtaaatatctctcattaatacaacctcacgaagaaaaccatttgttttcttagagagagccaagaatattaaaagagatatagagaaaagatttgctttaataatgccaacgtcgatacagtttcagagatcctccaccgccgcagaagcagccaacgccaccgtaagaaactatccccaccaccatcagaaacaggttcaaaaagtgagcctcacgcgcggg

SEQ ID NO: 4389 - DNA, 1550 bp, Arabidopsis thaliana
ataaattaatgaaatgatttgtttatttttattttttttgggagttttgaggtcagattgaaatcaaaatttttgtttccccgaaatatggcgatagatgatcacttgtaagatgcatattcaattgttaaactctcgtttttcaatcgaaaaatgtatatcgctttgttatttaatgacttggaaatttgagttttttttttggtttcttggtgttgtgggagttttttttttgatggacatttgagattagaatatataggagcaaagttgaaagtttatttcagtgtatgattgtatatgaaaataaagagtgagttgtttcttcttaccaacttctgtcagtttttagctaaaagttgaagaagaaagggtatcttttcaacgtctgattaataggagttaggaccaaatacaatggcccaatcacttccctaaattaaatgaatccaaccatcgagagttggagttttaattaattccataagttaaactggcaatggacaataaaatatgtggtcctaacattactgaatctaagaggaaaaaccaatcttactatgaaaagaaaaccaatcacaagcgtatcaaatgcatcagctaaaccttaagaaaacaccatcttccatctatcttctctggtgtcggatcctgcacaagacaaagctgtgatcatcgcaaagggaataatactgagtcatgaaccaagtatacttccataggaattacaattctgtttcttgcggtacacgaaactctccctgtaacctatcaacatctcggcttcgtcaacgatcggaaatttccaatcaatgggtctccaagtgccgccttcgctctctccgtttattgcgggtactttgcgatcttgcggtctattcgtcccatccttgtctactcggaataaaatagaaccactctctaaaacttgaagaaaggatgtggtgttacgtgttgaagaagccacaactcgacttggtacaatctcttatggagctgttttgccccttttcaaccttatttcgaagatagtctctcaccagttgaaaatcgcttggattgaacactgaaccaatctgattagtccccttatttctagccttggaccgttgtaagatcgagaaattaaagtagaaaaaagtagtttatgggaagcgtatgcgtgtgtgacttattcatcaccagatttgtcacctcaaccgcagcaaccattcgcaccataatacaatttatcttctgcaatatatataagttagagagactattaattaccggatccgtggcgcaatggtagcgcgtctgactccagatcagaaggttgcgtgttcgattcacgtcgggttcaattccccgaacaaatccggatctcaacttttttaattttcgttttcatctcaaccgtccattgtgaagacttttaaaatacccatcaacggctatgattagattttacacaacacaaaaaccctaacaatccctaattctccagtctccgtcttcttcttcatttcacagtcatcttcttcatctaaaaccctaagaaaacaaca

SEQ ID NO: 4390 - DNA, 2000 bp, Arabidopsis thaliana
tttaaatgcgacagttacaaagataataacggttggctacgcggaaaacatacttgctcttgttgttttctttgcagaactaatggtctttactcaagatcacatacatttttgcaactttactcaaaactaagtggtaagaaaactgtaagagtataattcaatttgatgtgtcaataattcaatataatattgtcacattttagtagagaatgaatctatgttgagatatatctataaaaaaaaaggacaaaaaagaagctatattactgagccaagaaaagaagaagttaagtctcaatctcttgaaactgtttttgttcccacaaagtaaaagaatcaacagaaatgagtcgggtacgggtccggtttgggacctacgaggcagagacagagtgagaatccgagtcacgaccggagtgatggtcgtggaagccagcctggtctgaattgtaaatgggcctattaggttctgaggcgtagaccgtacggactgttaccatgtgcttttacaccaacaacaacacatttcacaattaatgtattaaaaatattattataataatattaaaatcaaaaccgtaggttatttttttttaggacctatatattattgactttaaaaaaaaattcatttcataacaatagataattggataatttgattttctattatttcatttggaatggacacgtggtggattaatgatggtggttttgtaaagatataaaaaagtaaataaataaaatagcttctctacttaaatgattaaatgaatgtacgttaacgtacgtgttagatttttttcatagcgaaggaaaaatttaagattcgcattggtcgtgtcgattgtgtcaggctaaacgacgacgtattaacgtagatgacaaaggggtccggtcccaatgaaaatatgacatatttttttgaagtgattttgttttgtcaaataagttatgggatataaattgcaatttgataaaattatgtaatagatatgacaatttggaatgtatctgttttcttttttagtttatttagatttttaaatatttccatgcttttattcttattttctttgtgtaagattactttctatagtttcatttatagtgagttaaataatttaatattgcatttatagagaatgcattaatatagaatcgcctaaaaaacactaaaaatactcaaatctcaactaaattaataacactaaatattttatgtactaaaaatttactcgacagatcttggtttctagtacatttttgtttttttgttttgtcttgatattagcatgcaaaaccaaaacataaacatgtgttatctccaaatcaaaaacctaactaccattttgtaaattgtaactgcgattctatttacatcttcaaatgtttttttccctactaatccaattaatatttcttactatactttatatataatatggaaagaaatcaaattattggtatattccctagaagtaaatcgtggcgtttccaaaataatcagattgtgttgttgttataatagcatcaaaattaatatagaagacagacaatgacagcttgtctttatttctccgtaatcgttacacttacacaaaatttaatttgttttcttactatattaaaaatatattccaagttgaccataaaaataatcaataaacaaaacgagtaattacaaataaaaataaataaacactctctctttctctctttcctcgtcttcttcttcttcttctttttttttcgtaaaaattcttcttcttcttcttcttctccgagctccgtccgagcagagaagaagagtaaggtaagttttagagtgcacttgtgtggcactctcatttcttatcctgcgcctcttacgatttcttatggtgcgcttctccgactagtttcggtgtctaatggactcttcctcttcttctctatctctccaagaaaaaatctcttctggttatttctagggtttcgttggttcttttttcgaa

SEQ ID NO: 4391 - DNA, 2000 bp, Arabidopsis thaliana
gagttgtgaggaatgtgaatttgttttagacattaaatgctctactctgccaaacattgttaaacacgaaaatgataaagatcatttgttgtctctatgttatggagaaaacaaatgtgagcaatgctggtgcgagatgtgtgaggagacaataaatccaaagaaatggttttattcatgtgatcattgtggcattgcttttcacatcagatgcacacttggagacttcatatggtttaaaccggaaaaaaaatctgaatcatccaccaattgtgtgattcttaataatcgtgcaagtcggccattttgttattcttgtaattctcgctgtaaatacccatccatcttgtttttctatgggaaaacattgtgttctttgcaatgtttccaacaaaaagtttatgcaatcctggcataaatcttatttattttctcaaatattttatgataaaaaacaaattagattatgtgttgcatgttaatactatatatattttaagcatcaagtatattaaaaaaaaatttatgtgcaatttggaattcaattcgatttaggttggatttctttttatttctttgttatacttttggtttagaaataatagtattcaaaacaaaatataatatactttaagtttcgatatgtattcaaatctaatcaaatactaaattttataccacgtcgtgcacatgatgattttcttttgaaacaatttgtgaattttgataagggtttattggtaacgagtgtttacttgttgctgtaagaactttttttttgttttttccacaaaagttggattttattgaactgaaccaatcaatatgggctaatataaacaaaagccgtataactataattttacaagaattaattaaagcccaacatgagcctaaacataaccctaatgaagaggaaaatacaaaaagcctccatcactaacacgtgtttcaattagaacaaacagagagcttccatcacagaccgactttaaccttgccgttcaccaccgattccggtgacaagagtcatcgtcgatattaatttgttcagtaaattttgtggtttttcaccgtttaacaaaatcggagcccataagaggataacagctaaagggaattgatagtatgcttcagttcttctacttcttctctttaattaaaattgcaaatcactgggataattaaaaaacctttcccaattaaaaaaccaaacactcaaaagataaatcagtgaaaacaattgattagtgaaatttactaaattgcaatcaccaatgagaaatcccatgaaattatttaaagcaaacaaatatggaagccgactaaaagatgttaacgaaaccatctatgtcagttgataagctggacatcactgcgtgggaagccaatagattccagacggaagccgaccaaagatgttaaagaaaccatccatgtcagaagagaagccggaaatcacggctgaggaagccagttgattccggacggaagccaactatcttggctaacagagtcataagatgctggataaaagcccgagtcatacgagacggcgatttactgaaaaattcagtcggtagaaacagagttcatctctgtaaaagatatgtaggaaaaaagagagaactttttgttttgctgtaaagaactttggatgcaaatgtttttactatttgtgaaactattattttatatttatagccaaatttaattttttaactaaacaaaaattatgccgtccatatagtatcctgtaaattaagttttagattattaattttgttaattattgataaaaaaaactcaaataatgtcatattttctcttaattcaaaagttaattgtgtataatttgattggttcccccaaaagaaaaattgattggtttagtgaaccgataaatccaatctcgtaccgaccggttcaatgggttttgtatttgctcctctgtgctctggcctctacactttggatagctgccgccgaagttttgtgca

SEQ ID NO: 4392 - DNA, 1289 bp, Arabidopsis thaliana
tctcgaagaacactgtaatcaatttcctaatttctacggcaagtcaaatggatccgattccggttcaccggaagtttggtattgcctttcgattccggtagattaaatcagtaatctacgttttagcaaagatgagctgtttttgctgtattgacttatgggccttaatgggcttattgggtttagtttttatttttatttttataacttggcctcatttttctgatagtgaaatgtaggattgaaaagcataaaaacattataaacaaaatagctcaaaacttttttttgttaaataattgtgatataataagaaaaacgttttgtagtttttttaattttgaattattttttccacatgcatcaaatataacatacacatgaaaatcaaatataaatgtatgataaatattgtgaatggtaaaaataatagaatcacgttatgaaaaatggtatattatacatcatcgattggtgtctgataagtttggaggaaactttagcaataatacaggttttctctatttattcattagctaataggattatttatacaaaaatcataacttgattagcaagttctttacatttatgataatattaaattttctatctaacaataagaaaatgtacacaaatattaattttttattaatgataaaaaaaatatttatcttgatcccgtaattataagatttatcatgaactatcgatatcccgatctttcccttcccacttcccgcaaatttatatatggtaacacgtgtaagattggacaagccttctaaacaacaattttaatgaatcgatcatttttcgtgtatatatgtaaaagtgaaagaaaaacaaaaaaatcaatcgaccagataagaaaacatgtcggaaaatggagttaaaattatcatcaacactagactagacgccaaaacctataaacaaaaaaaaaggatagaaacactattgttgtgcagtttctttcacattactccgtagctcaatggttggttagcgtttaataacgccttcctctctgcgagttcgagttgagtcgcatggtggtggtggtgatgatgaagttgatgaggttgttgttgattagagtttaaaccaaataaaccctaaccaaaaataaataaggtattcttaaatactttttttttaattgtttcataaatgatcaaattcgaatcgaatcgtacaacagaagctctggtgttgaatcgccatgaggtttttgcagatctgaggttttttctcgagaagtaagagagatctggaatttggcgacg

SEQ ID NO: 4393 - DNA, 834 bp, Arabidopsis thaliana
tttccatattgaatcatgttttggatcataaaaggttcataatcattacacttatggtgcagcaatgtaaccacttttagctattaaaagtaacattaaaaatctaaaaagttttatcttctccattaaattcgctcttagtctttacaaatgtcaaattgagtaatcaatttctttcggtaataatagggatgtgcattttaactaaaccaaaccgatccaaaccaaacccaagtttagattcaaaccattcggttatgtttcttctcaacccaaatggttcggttcggtttggtattaaacaaaccgaattgacaacccaatatatttatttaattaattaattaataatattgtatattactaaatatgaaatagtttgcacttttaatttcttttcatggtttttttgaattattaaaacttttgcttaagttaactattatcaaattcaaagttcaaacaataatgtacggttacaatgattagttttttaaaaccgaattaaaaccaaaccgaagaagccaaacggaaccaaacccgaacatagattgatccaaacccaaaccaaaccatactaacctcggttgagtttgattagaattttacaaaacccaaataaatcgaaccgaatcgaacacaaacgggaccagaaattaaacagaaatgccgaaccgaacttaataatttcttgttttttctgaagcccatttgaggcccaatatctccctctacgaaacgacatcgttcttaccgaaaacgtctgctatatctgacagtatctagcactctgcaagagaaacttcgaagattttgatattgtaacgatccgcc

SEQ ID NO: 4394 - DNA, 2000 bp, Arabidopsis thaliana
gtttaatttgttatcaattaaaatattttatattttaagctaaataggagtacaggactatagaaggcgaatggtctacaaatgtgaaattgacacgttaactaagacctaattcgatttgagcatcttggtattttctttaatattcgtagacctccgcaatgcctgaaattagagcatcttactgtcgcctaacatttatgcgtcttctatattagtgttcatatgttcaagaggagatctacgttgtacgagttgtttttttgtaatggttaaaatgagtatatcttcacacatctacaaatctagagcttaaacaggcttaaaatcagatctcaataaatcatcatgtatccaaagccaaaggtaagctgatttcaaaggtgtcggaggaagaaccaaaaacatagagaatatcgaatacataaataaatgaattaagtacccccacttgccacaagaatataaatttgcatcaaactttctcttattttacaaaccctaaaagagctacatctttcgcgatcactaatgtttacatcaatcaactatttaagtaatagaagctttccaaaaagaaaaataacaagttgaagatagtcgatagtgattatgattaagtctcactttttttaatacaaaagataaagtaggtctggtgataaacaatccatttgatttttaaatcacaaaagatatatttgtttttttataacaacggaacctacttgtgttataaatatatgaattacaacaatacatattgggaattttacaacacttggatataatcttactaacaaaagctatattcaagttcttcttgtgaatctttgttatttggtttttgaaaaacattatagattataatagaattttatgcgctacatgataaaaaattgtcaacgggtatatgagtaaacacatatcacatatatatatgatatgaacgtcgaagctgtctttctactttttgtggtcttcaacattttcgggtcgatgtctcaaatgttgtttgttttttactaaacaaaagaaaaagaaatcatagaacttattagtaaggactataactttttaaaagattttggttgtagaaattaggctgatatttattttgtaaaaactataagattttgaatttttgactttgacatgaatattagtagggtattacgtaaaatttgcaagaaatgagaattcaaaaagagccaacaaaaccaagtcctgaaaatggacatgactaattaaagaaagaaaatgaaaaaacaaataaacttccttactatagaaattattgtttctttttaagtcaatggtttgtttttttttggtttttttttcatgttacttgtttgtacatccatattagtcttctattatcatcatgataatacaaagttttgactctaccaaattataaaaatcataaaagacgaggagctccaatcacgttcaagtaatagtatagatatatggaaaggaaataattaaaagaccctaattaaaatttagttcaagacctactttaaagccttttacaaaaaaagaaaagaattctctaagtcgaaatcgttatcgtagtacgttcatgtcttttctccggccaccgaaacgatgccatctgtttagtgcgcctttataattcaacgaccctttgtacttttccgattcctctttctctataacttcatctctcccattctcttcactcttctcaaaaattcgatctttagggtttttcttttatcctcttatcgctaatctggagctctatagagactataaaggtatgtttttttttcctcaattacaggctcggatgctcaaattttgtaaaaaatgactattttctattgctgaattgctcgaattgttgtgaatttagggtttttgattgattcgggagctcgagatttgacttcttttagctgattcggcaagtttgtatctagaaaggatcgattggtgaggtcaatagtggttggtgggttttagta

SEQ ID NO: 4395 - DNA, 947 bp, Arabidopsis thaliana
aaatgggctgaaaatctgaaatcaaaagagggatcttatgattcacacagcagacaacatctcatgctatgaagcatttatttgaatgaactaaaagcaaggatttaggccgtttttatttgggccaagctagatgacattatacacttcccttaattagttgaattcggtttttcttaagtacactttttttttttctttgtcctaatttttcttattttcaaatttagtttggatttcgatttttgcatttaccggtttgtataataaataaacgattctaatttaatgaaggactgaaagttttgtttcgttttcgaattaattattatgatgtgctctttattttaatttcatttaaagtcaattatcaaaattaagctaatgtaaagagtgtggatcgtcagatctggagaggtgaccaatcgtacgtcccaggttatatgagttccaacactgacaaacgatgtcgtggcgggtcccactggttttcggtaacgcagtttttcaaaatctctcattttcgtcccttcgagccaaatcaatggcaaaaaattagcttttagaattccccaagaacaaaaacaaaaaatgtccgagagaaattagggaaaaacaaaacaaataaaatctgggtgtaggggagagagagctcgtgctcgtgattttgatatctatctcttcgttatcgattttgaacatccacattgttcttagatctgaagaaaaaaaacacgggttctgttattacgatttgctcggcgattttgacaccaggctttcaattcttttcgttggaggtgattcgatttcagatccatcggatctaatctcggcgagtcgattcgtggtcgacatttttcaaaaactgctcgcgtggatctgaagaagagacattgttgtcttttgtatatcggcactgaatttttctgggaatctgtgtaaag

SEQ ID NO: 4396 - DNA, 2000 bp, Arabidopsis thaliana
aaaccctcaagattgctttgttatgaaataaaaacacatatccaatagaaaagcaattcgaaattcattaagatcatttaagagtaaaacaacataactccgaaaataaatttaaaaaaacaaaaaaaaacgagtaagcatatttggaaagtcactggatgagcctagttaactaggatctaagctaagaaatagtattagttcccttcaatcaaatcatatatgtgggttacatcactattttatttgaagcattcgtgtcttgtttttaatgtctaaacatactcagcactcttataaaagtatcatgattgatgaaagagcatatatatgcactaattaatgttaatttgtaaagagataactaaaaccattatcagtagtatcttcttcctctttctcctttttcttatatacagagacaccattgtattttcagtactacatatatatttttaaaatgattcttaaaaaaattagagattcaacaattcgtagaaaaatagttgctggtccattgaacgttgagataagaagtttttaaaaaataaaacagtttttcagttgacttcggtgttggtacctgctcgttcatttttataaacctagtttaattggcttgacctgtttactctatttctaacacttcaatagaaaacttttctcaaatttttctgaaactatgtttgttttacacttttactgctgcagtagtacaaatatatcgaagttgtctcaaaaatactttctcaagttcataattgttaaaacatattctcaagtcttcttagttaaatatacttactgacttttatttattgttcatcaatatgtacgcattaataagtcacttctttgaaaggaaagccttaaaattatttgttttatgacctgtttgccacttttaaaagtttaaggtcatatagtttataagagtcaacaaatatacatgtggtcgattcctcacacctattgtattcaacgtgctttttatttcgtcaatggatttataacgtcgagattcatgttacgatttattaatctcttttttttgttaaatacgatttattaatctcttcaaatttttatcaatctatatgcaaaaagttacatgtaaacaagaagtcaattagaacatggagtatatatatgaatctcatatgatattctggatcttactatgaaaaaaaaaaaaaaatatatatatatatatatatatatacagttgaaaaatattgttaaaccagtcattccctcataagtacattcagagtacatgattacttaaaactggtgaataatctgaagtatggaacttggacgggaaaaaactccattcctcaaaaacactgacaaaatgtattcaactaaagcaacttgtaaatctggttagagaagatatggattaataaatatgcatcacatgatttgtcaatatggttagccccttgagcgatcatcacatggccaatcaataatcatgccaattaattgaaaaagataggtctatggtgatttcccacaaattctcttagttttatttgtttagttggaatttttcaacgacataagcatgctcttttttcaacttgaatggcgtaaataatcctataattagtatttgactatttgtatagcaaatatcattaaacacatatagtatacctccacaaaatcaataccattggcattttctatagatacaagaatgtattggctggctctgtatcatcatgtctacgtagacagagatgtatcatgtcgactaaacaaaaattacatttccacgtataagatttacttatagtagtaactagtaataagtttccaagtaaaaacagacacatttaactaaattattattctaaaacatttttataaaaggaagaagaaagtcacagagatcgaacatgattctccactttccacttctttgtcttctttcttctccttctcacttacttaacccataagccatcaatcccaaacacaccattaca

SEQ ID NO: 4397 - DNA, 725 bp, Arabidopsis thaliana
ctctctgtatacaacaacacagaatttctctgaggaagaagaagaagaagaagaagaagattgattgaaatgaatgagttagaaaaaattctgatgtgacaataaaaaggaaaaaggggaataatgacgtcagcaaaatggggacacgtgaaattatttttaaaattatttgggacaatcgacacagttgctctatcgctatttgtttacgtggggctgttctctctctatttatataataatgagatacggttttttcagcaaccagattttaaagttatctgattaaatctaataataggatagagatagagtcacagagacatgttgttgactttatgacattattttattctttgcttatccactcagtcatcatttatctcaccagtcagacataatgtgttgttgttgtgaatttgtagatgcttccgactatacctgattacctggccattcagaatcggtttggatcaaaaaatttgggttttcggtttagaaatcgaaacaaaccgaattagttgaaacgaaccgaatagaaattcggccaatttggttttgcattggcgtgtaccttgtgactacatgtgtgtgtgttagatgagatctatccacccatttttcaaatcatttttgtcgttaagctatcaagattctgatattttcctgctcacttttgattcccaaaacaaaaaactttcttcaattattctattcatcttctc

SEQ ID NO: 4398 - DNA, 1669 bp, Arabidopsis thaliana
agttgctgttccaattgacaaattggaattgttactgaaaacaacgcagattccacatgtgaggtattatttcacttgaaaatgaaatgtgatgatccatagttatgtaagatttgtgagtcactcaaagttatttttcatacaaactctttatcatttctacattgtaacattggtttgttgtattgaagatttctgatacgaatggcttcaaaattttataaacataccaattcatgtatagtagtaacgcaaatgttgttatgcatgtaaaaaagctctgtaaattagacggattcggtttggctttaccggtagacgaatttctacgaatatttacccaaaccggtttatttactaaacctataccatatgaaccggaaaccaaacgctattaccgacttttcttcttcactctcttcgtcggaatcagcctttgcgcattcttctgagctcggatttagggtttagcattctggttctaatggcgtttaatgatattgattatcggatttgtttgtgctcttttgttagattttgatgtgtttaatggcataatcacgatttagctaagggctccgggccaactgcgttttccggtgggaaatgtaatccgtctccgatgcttatttggggtaagagagcaaacatgggataatactgcatcaatttgatagacctctatcactaatctgttgtgtccttatttataagctttggtaaatatgtgtgttcatgatttgatgattaaattatgtacagccagctttggaggtcgagccagtctgcaaacaggcccacttcccaaactatcaatgatgtaaccattacagatctggaacctcgttgaagataattgaaacagtcagaagccatgtttaggtgttttatctgtttgtagactggctcgaagttataaacaaactctatcaatgtctacactgtaatatcagccctttgttatgaaatattttgcattctatttggactcaattgttgctgttgttactcacactagtggttcgttgctactctgtttcagccaattacgacatgttcttctggtttcggcgtgattcatatgtacgcattcttacatgactcaacccaagagacactgattaggctataaattgagacgaacagaacacaacgaaaaaaggtatgctaatcttctgtttttttcttttaggcttttacaatgctttgattgccaaatgtatatgtatagtctgggaatgtgctgagcagcctatgacaaaagccggtttatttgtgaaattaatgacactgacactttagcccaatacttttcttgttcctctccatctgcctctgcgtcactgggtttgattctatgaatactttatcctttatgtcattatctgagtcaacattccaatcaatattcaacaacccccttattatataatgtgaacaaagaaaatattattgacttttagcttttgacattgactttgacttttgacactcgttttcgtgaccatatttgtaggtttcaggaccactgtcatcaatttgacgaattcaatatttgaaaattttggagagaagcttcgattttgcttgtttaaactggtaagaaacgtacagatgcgtcaaacactaaacacaaagatctagcttttgctttaatcttcaagaaaca

SEQ ID NO: 4399 - DNA, 2000 bp, Arabidopsis thaliana
ttaaccttgatcttttttataacaaaataaaaataaaaattggcacatgatcaaatcatcaatctcaaataagataaaaccaaaggtgtaataaggttcatttttttgtggagaaaccgagtcaatgctaccaaattgcctatataggcttgaattttatgtaaatgcttttttgaatggaataatccgattttttattttattttttcttatgtaaaattataacatggtatagataaaaaatttgttttgtaataagtgatatttggtctaacggcgcgtatgtatagttcttttacaaaagtgagtaatagtggttttctggttcaaatactattgagaatggtatcagttttgatggacaacaagtgtatgagactcggctataacttctcaattaaccattaaccattaaagaatacaaaatttggattttcgactatactttggttcggatacatcatacatgcatgcacaccataacaactaaactcaaaaggatttgtttttgaacttttgatgataagaaaaagaaaaaaaagatgggacataagagtcatgtacacgtggataaggaaaggagaagagagggacaagggaagagatggagaaagagagacgtaagtattaattcaattgtgtgccctattagctttcattttccacaagcaagaataatattaataattatgtatcatctttgcatttttgtaccaatacatgatacatttgttaggcacacgtctttttcctttttcctcctttttatttctaactttcttccttttattcgtttaatccggctctatcacgttaacacacatatatgttatatcatctttttacaaacatgtttacattagttattagaaaatacatatacttgtaatagtgacattggtaagaagaactctatcaccttcacaatcacacacatatatgttatataatctttttacaaacatgtttacattagttattagaaaatacatatacttgtaaatagtgacattggtaagaagaaaaaaacactattaaatagtgaaaaaatgtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttatccttttttctttaataatatgcaattgtgagagtttggatttgaatggtagcattagaagcaaacttgaaccaaacatatttcatgaagtcaaacttgaaccaatgtaatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacaccgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcatccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggacg

SEQ ID NO: 4400 - DNA, 1235 bp, Arabidopsis thaliana
ttataagaagaccctttttttttttactttcgcttttaccacttgcgttttcatcttcttgtattgttgtccacctcgttatgtgtcagtgaaatgccaacttttcgaattgaacaactcttgaatcttaaataactcatactattataacattgaaatcctcaagtatttaaaacctgttgttttcatctgttagtgaaaaaaacctatgtatgtatgaaacgttaaaaccctaaattttaccacaaaaaaaaaacgttaaaaccctaaaaccggcatccaataacccattaaacatataagaagaaacccatgctttctgagcaagaaacggttctgcttagttaggtttgggctgactaaaaagggcccaaaaggcccatttgaaatcacggaaaataggaaaaagttcaaggggaaggagcagccagagacacggagagtctgtgtatgaaagtgaagggaaaaggagatcgacgtctcctctcagactctcacgggaagaagacagtctgtgactttttgtgtttccagctgttttcatatcatttctcaattctcactcgtatacctgacaatttgggttaccaagttgaccgttgaaatttgtgtttatataataagaattttgtggactattactaatttactagtattattttatacttccagcatatatacatacatacattgcttcttcatattctctacgcgttcaatcaatatttctcgtgtaggctggctatttgtgccaaaatacaactcaaattgtttcaccccaaaaaaaaaaaagcagatacaataaaataaaatttatataattatatgttaattctcatttgtgtaaaatattgaagcagcttaaaataaaataaacctcacagtaaaaatgaaataaaataccttgcaattaaatgagaatgcttatttttaacaaaataaaaaataaataaaaatcaatgcatcaccggattgggattttattttctttcaaaaaaataaaataacaatccccaacccaaaggacaaaataatgggtatttaattagtaggtggggtggccttataatatattacaggttgaaataaaaacacggaattagctgattggaaaagcttccccctccccattggactttaaatacgacaccagagtcatttgttccgttactacaaaacagagttgaagctttctcttccaactttatcttcttcttcttcttgtcaaagcgagt

SEQ ID NO: 4401 - DNA, 1082 bp, Arabidopsis thaliana
gttacaagaacaagagtatcgttataaagtcaacaaagattgaaacatatttttgtcaagggagtggttagaatctcttcctactctcttgcctttctcactaagacaaaaaaaagacttggactttgtctaaggttttgtggatattattaaccaagtccttttgcaaaaagtaatattgttttttcgcattcctcttttagaatttagtttaatctaggctttatattggttattactttcttgaaaaatgatctgtttattctattcatacttggttacctcgctttttatcttacttctacaaaaggattatcagtgaaagttagtctcttactctcaccttccgaaaataaaacaaaaatatcgatacttctagatcaaaccaagttgattaaaacatccctattccctacgattctgatcttgagatatattatcatgttaagatctaaattgacaagaaaactgatttttcatttctagtaggaaaaataattactattagtgatcatgattgtcgaccgtaagaggtggtttagttactctccatctttctttgaagaagtcagaaagtcagaaattatatcaaattaaacatcaatattgaacacatatatctgtatggttttatgtttagaaaattccaatatttatatattcctagggaaaaagaagcttattcttcaaattattgttatgagtcgttaaaatatggataaaaatataaagtctaaatattaaaaactcagtttgctttgcttttacctctccaagtctccaaagtcaaattaattttagttaattaaaccaaaaaaggtttattagtcaaacttagcatgcaatgctgggtaccaaacccaagcattagtctcttttaatcttctttttctccaataagtttttacaatttttaattgtttgcatttcccttgattatttatcttcatcccaatttagctaataccaactccgtttcttattcttccaagtcttttcctataaatacgttcttcttcccctcttatttcatatcactcaccacaaagtcttctcatttcctcatcttcttgttgaaagta

SEQ ID NO: 4402 - DNA, 2000 bp, Arabidopsis thaliana
aaaaaaatgagaatacaattaacacgaaaaatgcaaaagactgttaaaccgaaatcgaattctagtgtaatcaatccttttcccaatgatacaactataaatcaaaaagaaaaaatgtactgataaacgaaactaaacgtataaattaatatatttcttgacataaataggaggcttttgcctgctagtctgctacgatggaaggaaaaatgcatgcacacatgacacatgcaaaatgtttcaatgaagacgcattgcccaattaaccaacacaccacttcttccattccacccatattatttatttctaccattttctttaatttattgttttttctttgattcatacactgtttatgactattacattttccctttcgactaatattaacgcgtttaaaccaaagaatggatttgataatgaaattttattttattagcatatagataatggatggcttcatgcttggtttccatgacaaggaatgacacaagataattattttgaataaaatcataaatatgataatactagttgtaaaaaaacttgagtgtttcgtgtgttatttttcggtttcttgactttttatatttctcgtttttgtaattttaggatggattatttagcttgcttttctcttttattactttctaaaattttatttataaactcatttttaatatattgacaatcaataaatgagttatcttttaattaataaaaaatttgtaaactcttgtaaacagatcatagtcactaaaagctattataagttatttgtagctatatttttttatttcatgaacttaggataagatacgaaaatggaggttatatttacataaatgtcaccacattgcctttgtcatgcaaacggcgtgttgcgtcactcgcctcctattgggaatcttataatcgcgtgaatattattagagtttgcgatatttccacgtaatagttatctttcacaaattttatactcaattacaaaatcaacgaaaatgtacatttgtatctttaactatttacgttttttttacgtatcaactttcagttatatgttttggataatatatttttttacttttgacttttcagttttcacctaatgattgggatatacatatgcatgcatagttcccattatttaaatgtaagctaagtgcatatgaactgttagtcaaaattacgaagtttatttgtacatatatatagttataacaaaatggtacagtaaattaaacagaacatcaagaaagtacaaaagactgaacacaataatttacatgaaaacaaaacacttaaaaaatcatccgataaaatcgaaatgatatcccaaatgacaaaaataacaatatagaaaatacaaaaacaaaaacaaaatatgaaagagtgttatggtggggacgttaattgactcaattacgttcatacattatacacacctactcccatcacaatgaaacgctttactccaaaaaaaaaaaaaaaaccactcttcaaaaaatctcgtagtctcaccaaccgcgaaatgcaactatcgtcagccaccagccacgaccacttttaccaccgtgacgttgacgaaaaccaaagaaattcaccaccgtgttaaaatcaaattaaaaataactctctttttgcgacttaaaccaaatccacgaattataatctccaccactaaaatccatcactcactctccatctaacggtcatcattaattctcaaccaactccttctttctcactaattttcattttttctataatctttatatggaagaaaaaaagaaactagctatctctatacgcttacctaccaacaaacactaccaccttatttaaaccacccttcattcatctaattttcctcaggaacaaatacaattccttaaccaacaatattacaaataagctcctatcttctttctttcttttagagatcttgtaatctcctcttagttaatcttctattgtaaaactaagatcaaaagtctaa

SEQ ID NO: 4403 - DNA, 1349 bp, Arabidopsis thaliana
acaacgatgagatcagtttcaccgtttgtttatcatatatgaataataactcctaggccgaatcatttttgtgaaaaaaataagtttggttgaggagaaaataagtgagtggtagggttgtgttttacacttttgaaaattttaatattctaaaacattattatgcctaaatacatgcatgcatgtataacgtctatcgttttgatacattttgtggatttgaatctaaattgtgtcacaacgacaaaatttaaaagaataaaataaaaaactagattcatgtcatgatttatcaaatctaatgtttttagtgtcaatcaatggaaaaaattataattcatgagaaataaatagaagtacggcaaagtgatttgaaacataggttcatattttgaaaaatgggaagcaaaatctattaatagatttcataatattataagattcataatccttaagttacttgcgcattttgattgtttattattctatgagttaatgtcaaaggaacatctccaaaagtgatcgtaagtaagacttttgcagattcttcatcaaaatcagtgaagtaataacaactcattataaaaggcttgattatgaatccttttctggttttctgaaagtacagctgtaaagctccaacaactattgaaggcagcagttctttcaaatattagttatcattcacagaattgtgacttataactaaaactttagactaacatttaaaaaacttatctaaaaattttgcgtattccttgtgacaattgagaactcctttcacaatctcatatatatgaaatttcccttgattaaacgtgggaatctaaatgcattaatcattatagatgttggcttataaatttaattttgagattgaaatgtggccatatcatgttttagtgtattcattttataaaagaaagaaacaaaaaaaaaaaatcttgattttcttgaccaccgatttcgtctcacgcaaaatcctgtataaattataaaaactatatataacttcatttaccaaccgcgtgggaggattacaataatgcaattgatggagatagtataacctaaagacaaattacttttaactaaacaaaatgtagaagcaccagctttcttttcccatcttttggactatgtagacaaacacacacgttaatctatagttattggcttaatttcaaaatctttcactttcatgatcagtcaagaaatacgcgtttaatcgactttttctctctatatatacaattctttcaaaatgatcaaacatagtcataagttccgcaccaatcagtggaaataactaatcaaaactctgtatcatcgttttcaaaacctaatta

SEQ ID NO: 4404 - DNA, 2000 bp, Arabidopsis thaliana
cacttttcatattttttggtgtgtatttggagttaacaaccatttgtgattttgttgaaatgaaaacatagagttcgtgaacaaatgtaccttgtaaccattttaaattcagttaaagtaatttcctcaagtcatttggctaataagtaatttccttaatcactttttccttgggccacaaataaaaaagaaaagcatgagactgagaccatgtaatctggactcgagctaacattagacccatagttctcttgatatttagtgccaaaggcccaacacctagttttcttaaaatgatagtgttaaccttaattcccttatttcttagggattttgatgtgttaatgtttaatgaagaactttcttccgttttatattttgtacaatatttatgaaaatgattttttatttgaacaaactaaaaaatatgaagagttttcactttcacgtataaaagcaaacataaaataaaataaaaaaattggacagataaaaacaaaaattggtgtctgaaataattgaacactaatgaagaaattatttgtctataaaactctgcccctataattatcagcacttttagtttttagccataaaggtttcaacttttatcaaagacccagcctttttgcaagtggcgtggtttcactcgttgggcctataaataacaactcaacctcgacctcccaccatcgccactaaaacgaaatcgtggtcttactctctcttctgagttctgacctgagcacacacacagagattttgattgtgtcactcatggaacccaatatttaccaacttgccctcgcggctctattcggagcttccttcgttgctgtttctgggtttttcatgcatttcaaggcactgaatctagtccttgagcgtggtaaggagcgtaaagagaaccctgatggagacgagcctcaaaatccgaccttggtgaggcggcggagccaagttagaaggaaggttaatgaccaatatggtcgcagtcctgcttctcttccagatgccactccttttaccgatggtggcggcggcggcggcggtgatacaggacggagcaacggtcacgtttatgtcgatgaaattcctcctggtctccctaggcttcatacgccatctgaaggtatgagaaccaaacctgaattgatcagattagattgtggattataaaaattgatcctttaatcctttgatgatgctgatagatagtttgtgattgctttttttcagggagagcttctgtacatggagctagtagtatcaggaaaactggaagctttgttagaccaatatctccgaaatcccctgttgctagtgctagtgcttttgagagtgtggaagaatcagatgatgatgataatttgactaatagtgagggtttagatgcttcctacttgcaagctaatggtgacaatgagatggtgagtttctttatttatcattactttttcaatccctgttctgtgattgaataggtgggtttacaagtaagatgttttttgcagcctgcagatgctaatgaagaacaaatatctatggctgcttcaagtatgattcgatcccatagtgtgtctggtgacttacatggagttcagcctgatcctattgctgctgacattcttcgtaaggagccagagcaagagacctttgtccgtcttaatgttcctcttggtaagaatggtcactttttgtttcgttctgtcatcttgccttacttctggttcctgtatgcttagtactcttttcctattgttacaaatcatgacatgtttgttttataagtcccactacttgaaaagttttttgctagtggcaagtaattaagtggagttacggacaattaaataagtagtcttgagtaagagaagcaagggtcagttaaggctttactcagtgtgggagctgagccattgaaattcttagattatagtttaagaattatagcttgaaacggttaagacgtcaacacatatcttattcatattttactc

SEQ ID NO: 4405 - DNA, 2000 bp, Arabidopsis thaliana
aataatattggcatacaggctggcttctttagtcagaaaagtctctgaagaatccaacaaaaaacctaaaccacttttaacgtcatccttatcttcgttttatttttcttttaatcagaaaatcaaaaacaaaaacagaagaaactggaatcactcaataagtatggatactttacttatacgtttctaatatgtatagatacgtcaattcaatacgcaaaatacaatttcgaaaaaagcgacgtttgtgtttcagtgcttttaaattgaaaacaaaatgtgttttcacacaacaaaataaaaaataaaaatattcttaaatttgttgtgaaaccaatacaaaatacaacgttcaaaaaagaaaaactaaaacgacacacgacatatatgattttataattaaagtcgaaggaaaacgtaattttttctaaatctaatgaaaataccaacaaaagtttttaaacttaaatcgaaagagaccgaacccaacaactaaaatcataagcaactaaacacaaaccctttaaaaaacattagtcttcagaatcaataaatcctttattttgaaataactacggataaaatttattaagtatatgcgatcaaaccaaagataacattaattactttctatcgatataagaaacagtcccgtctcaagctataattgagcctttgccaaaataaaaataaaaactaaaatctcttaataaaattttgttttaagaaaattgggccttttatgcttatgattgtttttaaaatcagtaatagatccatggcatttgcctaatttgccatggggtaaagacggtcttgataagagtcaatctttcacaacctaaactaaagattttataatccgacaaataaaacgaccgaaaaaacttaaatacgtttttagatacgacaacgataattaatgtgcatctaattacgtttaaatagaaatcttcaaaaattcgaccataccaacactgatatgcaaaggaaaaacaaagaatgtaaccttcaaaatgcaaaaagaaaagataattaaaaaaggaaataacttaaaaacgaaatgatttaaattaaataaaaaaacgatccacctgtgaaacgctctcaagtaccacaaaatgtactctctctatcacacacagttacatatttcgttgacagctgtccccactaacagctgtttcccaaatccccaaccgttttcttggaaagattctctctttattttagcctcactctctcagacgcatttcccccaatcgcaccgccactccctgacgtgcttttttctttctcttttaaatattcaaatacgtatcagactactcacgttacatcttcttcataactaatccaatttagaaattacgcaaaattacttaaatatgtagtttttctaaatagttttacataactacaatatataagaatttttaatttgaatttattttttgaaaaaggtttgcatttataatttgatgtaatatgatttgattttagtttaatatctttgtttagttatagttagaaatacagtacatgtttagttataatttaacattcattaaaaaaacattacataataatttgtttaatagtatatattttaataaattttagtttagagtttattttgtttggttcaaactaaatttcagttttctggattttaaaataataaaacaaaacggcatatacttacatatttaatttggtgtcagttaacttatttcaatttgattcagttgaaaacataattatgcacgtaaataatccaatttacagttacgaaaaaattaagttgttgttaactaacgataaaaaattaccggtagaaccggtgacctctctaaccatcacacctcgtataaatactctctcctcttcatacttatcctctcaacaaaaatcgtttcgttcttttccaaaatccccaaacaatagaaacgcgttttaaacgatttgattagttttaaattaaaaagaagatccgagcg

SEQ ID NO: 4406 - DNA, 2000 bp, Arabidopsis thaliana
gagatctgaaatatatgatacatgttgacttttagtttgtgaagatgattcaaaaagagtttacaacgcttatataacttgattacaacttttaatgtcaatcactgatcaataagataaaactttgaatattctaatgtgtcattgttaagttgtgactatcaacgaactccaaacgtgactctattttgtttaatagaagaaaagtctttaaactccaaattgtgattttgtattatataatattcagaattatcgaagaaacttcctatgggagagctcttgtgaattattaacaatttggaatccaaacaactaggatttgtcaggcacgttgtgaagaccatgacattgatgtattgaaatatgcaataatttgtaattacataaatattgagatctgtttgacatgcccaatcaaaacatacaatcatgtcaataattaagtgatcccaaattgtttaaacgatttaccttagtgatcaaagtcctaaactcgtttaaaaaactaatggtcaaaagattcctaaaaaattgcaagtaggccacgaaacatagagaaagtgatatgaactttaagtttctaacaatacaccaataaaattatggtccagattttgatctatatgtaataggttcatgaacttagttttaaaagtcacaaacggtatacgtagattattgttaacatgaacgactaacaacgacataacacgcgcaattcatatgactctagatgttacccttgatattcacatgcatgtaaaactctcaatatgctatttgaaagtctccgggggttgccacgtcatcacatcgctccaaaggccccatttgttttttcatttttttttcctttattaaatgtttttctcatcgaccaatcgtcctctgactttttttattttgacgagggaaatgtattcagattcgagcggaaccgcggttggcccggtaaacccgatgactcagtcactaatccagtttggctccaacactacaatccgctaattttcaatcaggtaaattttgaaaatctctaataaattccggtaatggtataacccgcgatatggtactactagttgaaaccgtcgtgcttaaaaatgttgattaaaattcaactttttttttttggctaaactgcaaatatcatatatatgaaaaggatggttttacaaggaagttaaacccggaattggtttcttggcaaaataaaaataaaaaaggaaagcaatattagaattttggaccagacatgatcagtgcacttaaagccccaaaacccactaaaattctatttttaaaaataatttatattttctgttggataaaatatattatatgtaatcttttagatttaggtcaagatttaattgtgtcaatgaaaataagcggaataattatgaaaataagcggaataatgatgagtacaacttgtacattgtccgaaaccattcacataattaccattaaaattaattatgtaaaaaaattttaattgtaattagaaagaataattttggaaaaacactatataaagattaaaacaacaaatttaccattattctttatgaaccaatgcatttttaatcctttttactctttatataatgtttttaatccaagttactgttaaaaatatggaatttcgattctttttaatatttgtatttccaaaattattattatgtaattcaaattataaagattaaaaagtcttaaaataacattgggtcattatttgaattgatgtaaacagaaaatccattgtagacattttgaccattcccaataactgttatgagaagcctgaaaatgcccagtaaacaaaagaataggcccatataggcccaacttaaactactatagttcttcttatacctttttccactctcactcactttgctctctccaaatttcttcttcttctccggcgaagaaatcgaaaagtcattaccctaagagtcccagagtcgtcagaaggaacagcttttgaa

SEQ ID NO: 4407 - DNA, 1876 bp, Arabidopsis thaliana
agccaaaaatctcttatagctcaagagagcactcagactcagaaatagtaagtagcttgataaatgcgagtgagtgactagctagtgtatgttttctataattctatgtgacattatattttcgatcgcgtacgcatataccttatcattacctaaattgttcctaaatattacaaaatatcatatttgtatgatggatgtgtagtaactaaaaaccattcagtattcaatactcaactagaaaataaagtccactgggtcatattatctaaaatcttatcaaaactcaaaggctaatacaatacaatcttatttgggatcaattacgagatcagcacaattaagtctgtgcctttgtctagttaggtaacttctcatatgcttataaaaataggtacttctctctctgtttatgttacgctttcacccttctgcaatttttcttcatttttccaatacttctctcaatggtgatgacggtgaactacgttgacaataacgaacaattttttggtttagaattagtgatgaattggggattaattgatttgaatcttttttaagagtagaacccttgggtttcttagatagtattcttagggtttatatttcttccataacaaatcgtttaacttgattgattggattaatttgagacgacgttttggtgacggagaaaattggaaacaaaagagatagtgtttttgatggacttaaaagtgatggtgttgacaaatatggtgcttatgaagcaagtgcggcagtgagaagggattgaggatttgagttgcagaaaaaattgttgacaacgatggtgttgttatcaacactataacctctaacaaggggtaaaaccgtcatatcccctatcaatatatgcttatttccataagtccattcaaaaaattcattttttctaattattgggctaaaatgtgtccaatcttacaaaagccccatcttatttggctacattctattattggctggtccccaaacacttttaaaccgtatagagttggcataagcgtattttacatttatagggacaagggtcaaacacaggccatccagtcaccacgaaaggatcggatatatctcaacgtgaaaacacgtgagttaaatcaagaccgtaagatcagatatcaacggctctcccgcatctggatcatgcagctgacaataatgtgaacgtgacttctacctaactcttatattgtacttattcaaggaatctataattatttttcacaaactgccataacgatttagaaaagtagtcaaaattccaaaagttggaggatattttttttattgtcatttgacacaaatatatagagtagtaaatgtaatctttcatgtccaaattttatttttgacaaatacctcaatatgtccgatttaaattttcttttgtcaacgtccctttaatttttttaatcaattttttgtacttcattgtaataatatgatcactaataacatttccattatttcaataactgattaatttttgctatgtgatattaatgatgtaatctaaaaattgttgtactagtgagtagtgatgatttatcaatcaaaacaccaactcaacacccaagctataatatatacaaaaaaaaaaaaaaaaatctaaacagacaggcaattaaatatcctccttaattaaagacaaaaccccaaataattctgattttatatatcactagctattatgtaccaactaccatcgatcgcccatgcattacatgagcaatatgcagcatcaaaatttcaataaaagtctaattctgttattaaaaaagggagaaattacattctcacgctctataaataacatgagctgcaagaaccataacaaaccttatttcaa

SEQ ID NO: 4408 - DNA, 585 bp, Arabidopsis thaliana
gagggtttctctctgtcttttatgttccaagttctatcaattctcatgcttgttttctaaatttgcatacactctatgaccaacttcacaaaataagagttcaagaagatgaaacagagacctaacaaacacattaagattttttctttcatatatcttgttatcctcaaaatgcatttaccatcaccccaaaagccagtccaataaaaaaggtgatcctaatcaaaaattattaataaaaatttggtaaccttaaagatataaccattactttaaaataaataattggtcataagaaaagaaactggtcgtccaaatattacaatctgctccattatattgaaatcacgtattcaagctcataaggcaagttaggtccctattggtcaatttggttgtatctaccgttgacaaaactgtaacatccattgtggtaaaaattgggcatgaaaacaaacataacgacatatgataacatacaaggaacataatattaacgaagcacacacatgacacgtatatatatattcatatgcacacaaacacagatagagatgaacagaaacacatgacataactttccaa

SEQ ID NO: 4409 - DNA, 2000 bp, Arabidopsis thaliana
agatctaaaaaacaggtaatgagaatttggaggctccacacataacaaaatcaaaatggtccataaattaatacattaattagaaatgtcatagaaaagccaaatgcaccaaaaccttccttaggcattagttgatcattattaatgattcattaattaaccaactaggctcatgtagttttcaaatatatactatattagatttgaggttccaagttcaagattcgctttgcctggtcaaagacaggctctgatatgtaccaaattaaatgctagtatggttgaggattttacgtggcttttttggaacaaaacgagatttaaatatactatatagtctctagatattagtgtaagtgtaatcaagccctttttgttttatttattagtaaaacacatataaattgcctacattgaaaaaagcaacaaaaggttgtctcaatctcgtgattattgatttttgataaagcatcactttttaatgtggtcccatggccattcatattgtaactcttctcttagttctctatccttttcgttcaaaatccattctagtctctcttcacttaaaaatgtactcaccaaaacaacttaaatcatgttgggtctgattggtaacacaaaactttagctgttagctggagcggtaaactgttacgaaatagtacaaaactgtctaaaagagctgtacagaaaagtttagaataaaactttttgtaacgtttttgataaagtttttttgaatggtaactgtcaaagttgtacagtttgtacaactttgataatgagttaccattcaaagccgttatttattcaacctatccggcttcttattatgttcctaaacttacgacatggttgtattactcgcttaaatgtgttcttgtgattgagttggacataggttcaagcttatttggaaaagaaaagaaaacatctttgtagatatttactagagtacattgactgattcatgtatatacgtggaccaacgtcgattagatttgatattgatccggtatttgtatttatgtattatctatatgtatgcatatatcataggagactttgatcatttatctatgttattagggataataaaattaggagtaaactaattatctcttatatctatacacctagtcattagcgtggctaatacggcgacttgcctacaccttctgtgaattatataatatttggtttcattacgtttattgtgaatcattactaaattatagattaaatagggaaaacgctgtttttgttctaattttggctacttctgttaatgaattgattgtttagggagagcttactagctgtcgtgaaagctacaactattttaatggctaactttgccacctatatcctatgtatttattatgtaaaaaaaaaaatgtataaaccaatgacataatcgttcgtatagccgtcgacttctattgtatatttgctcaaacgtcgaccctttcaaaattttaatatcgatgtttgtcaaactcttgcagattttgatgaattcgacgctagattgcctttaacgaaattcaaatgttacatatacatagacgatatatatatacatgcattagatgtacatgattagtgctcatctacattaatatttcatgtatgtatatgtaattaaatattgaatttcattagaaacattttggtaatctcgtgagtttgccaaaatatgtttactttgtttgagtttgaccacaaaaaaaacactagaaaagtcaataacgtgacaaactaaacaagttgcctattattaattgcactcgatcttaattggtttgttctaggaccatttttagtagaagtaaaaccagcgaaaacgaatgtaggattcagtcgaagggtgttttataaaatcatcaaattattaggaacaatgaaatatctgtaaattaaccaagattatttgcgtttggttgtagcgtgagaaaagcaaaggctaataacagttgagagaagggtgtgtttgt

SEQ ID NO: 4410 - DNA, 1496 bp, Arabidopsis thaliana
ggacaacattacaaaacagattaacattactttatatatatgctgacctttattcttcaattcaactgtattatttaacaaggaaactttgtttcaacgtgtgaaccttttttttaagaaaagaaaaaagaaaatgaatgaataaataatgaaatataaaaatgggtgaacattactatatgggatatccattaaccaagaaattcaaaaatattactttctgggcgaaatatatgaattgttctaggctaaactttgttttttgtcagatggctgagtttagtttttgaaattcgtaaaaacaaaatgaataaactgccaacgttaaatttgttatttttctttttttcagccattccgttcaaattatatcacggttgaagcatatatatactcaatgaactataatgatataacaaaccctaaaatacataattattcttccaaatacattgcatcaatttagaatcgctatttctaaattctagcaaaatgcaagtatagtttccaccactgaatcttgtaaatttgtgaaaggggttgctaatttgctacaaagatggtccaaaaccgctaccgatatagcaaacaaccattatatatgatatctacttttcaggtatattttggtaaagatggaatcatgaaaccttgtcctttttgatgctagagctcgttgattgctctattgtccatccatatagggaagtaatctgatataactacgtacttatacttatgtaggaagaagatttttcatttggcggtgatattcctcatgcactttagggctcatatatgagttatattcaaatttaaattggttttaacattaatatagaaaaagtattttttccatactctagtaatttcattattaatgtcattgtggttgttgatttggtcacaccagctatatatattttgttattttaaattttgcatatagagagacgactatatgtatccaaatccctaatttgatgggactcacgacggtttgaacttcaattttttaacaaactacagctcattgtagaggtcatcgcaataattaacttacatgtccaatgcgtcgactttgcaaactagtactatgttatgatgtgatcgttttatttaattaaataaaatcactacaaggttcttcatgaagccaaatataacgtatcagactcaaattcgaaaatgaaaattaaatatatttttctaaaacaccacgagattttcctattatgataacttatcattttctcatcacaactcatgtacaagttgacttttgaagttcgaagatatctccaaaacaacaaacaaacgatccacatacaagttgaatattaaagatctttctaacaaaatcaaatattaaacatccctggtactaatttttaattctgtctatgtcgcgctctatgtatgcttatatatagacttttctcattacgtatacttcaaagttgccattttatctttctgttaattgttttccaaaa

SEQ ID NO: 4411 - DNA, 1469 bp, Arabidopsis thaliana
tgagcgacggtcaaatgaagctactagcggatgtttcgaatattatataatcgatgagataatattaaataaagatgttcgaatggctgtactcttttcaatttcctgtctttttttatcgtggcgtttctattatgtgatcgtctgtactatgttcgcaaacaacgttctttgaatttcagacttgaagtttaagttattctatactctatatctatactaacacttactttagtttaatcgatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaagatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtctttttgtaaagcagttttcatgttagataaacgagattttaattttttttaaaaagaagtaaactaactatgttcctatctacacacctataattttgaaacaattacaaaaacaaacaatgaaaatgcaaagaaggacgtaggcactgtcacactacaaatacgttaataaaatgtattttggtcgaattataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaat

SEQ ID NO: 4412 - DNA, 2000 bp, Arabidopsis thaliana
ctctagatgggtgaattttataagtttattacatgtaatattacatcatggaagttgatatgtctatatatatatactgtatattgcgtgcctttgtaatatatagaattcaataaaacctatcttttttatttatttatttcttttttggtcagacatttttttaaaattcgtttttcaactattaaaatgatttaaatagatacatatatacttaattggcaatccataaaatagttgaattgttggaattataatctgaaatcgtacccgaaaattcaggtacgaggcatattaaattaaatatcctaataataagagttttgggcaacatgtttatcaagaaaattgaagttgtatgaagtgtatgaactcaacattttcgagaattttagtcgccatttgccatatataattcaacttgtaacggatcgtaattaccacacttaccattctctgcattagctggtagttcagatcgaatatgttgttatataattttatttttttaaagtgtatttgttactacttactagtatatgtatatcattggtgtcaaaaccatatagttccacaatatagagattttgtcttcatgtcatcagttgaaagttgaaccacacttactttttctggtgcaaaagtaagataagaaaaacatttcacattggcaccaagagatgctatattgctttttattcacaaatgtaaattgtttttcaggtcaagagcgaaaattcctagacatatacctttttttaaaaaaaagtctatcacataagttattaattaaaaatatatttaattcactaaagagaaattttgtcacaaaataaaaagcagtctaccataagctaaagccactaagtttacacctcatagacaaacttagaacctgaaaaaagaaaaaactcttctcagttggtttttctcttttcaagagtcgaagtctcaaactcttctcagttgctagccttgttagccttcaaagaaagctgctagtggtgtaaggtctttgttacactggtgatgaagaattccggtgagacacctttatatagtcgtggctgggtttaatgaatagactttcactcaaaattttgagattttcggaaatttttgactagagaggttacaaatgatccagtttaaataagcaaaacaaatgtagtaaaccactattgaaaaagtgttatttcggtttatttaattagttagattgtaatattgcaaattttaaaattatctaaatgttcgttattttttcaataacatacaatgcgtgagttcaaatgttgatgttattgcaataacaacactaacaaaaaccgctaagattatgacccatgcacattaatacatttatgttgagaatagtctgattattaatatttacatgttattcaacatacaatgaaaataaaatggtaaaaatgtatttacacatagtaaattgatgcgtacaaaatgaatgtaaattgattacagacataacagaaatgacaacgtaaactttataataacacaataaaatagtaatcaaaattatacaattgcacgaataaattttctgaaattgttttcgtataaaaaaaatttaaacagtaaaacataattaaatgtaaaaaatctttgtgatttttttttttgtaaaaagacgtagtagaatttacaaattaaatttaaaaggcataaaatgtataaacagataaaaaaacatataaagatttcttaatattttgcattttgtttcttgtcaataggttttattttccaacctgcatctgccaaagcacccaactccacctgacttgtctgtgtctgttgcgttcactttcattggaatctcagattttttatttttttgtttgttttggttgttgcgagtttgtgactataaaacctctcccacttggttcttcactctcactgtttctcatctcttcgtcttctccgcctccttcaatctcactccgatctctctacgattcattcgttct

SEQ ID NO: 4413 - DNA, 2000 bp, Arabidopsis thaliana
ccgtttagtggatttggttaccaaaatgttgatatggccgagttggtctaaggcgccagattaaggttctggtccgaaagggcgtgggttcaaatcccactgtcaacataattattattattatttttttttttaaatttatatataggcttcaaatcaaacagtgacacttttttggtacaaatcaaatagtgacttatatattagagaaattgttggaaaaaaacaaatgtgatatccattgcttttgcggaaacgttgacaaattattggcgaaatggtgacttatatatttgagcaacatacacactcgtttttatcttatttttatccaaaaaggggaaagtagatgaattatgtggattttattagtgaatatgtgatgcatttcattagtgaatttgtttgtttcgaacacctaacaatcaattatgtttgagaggatattttcagggcggtcctgaggagagcaacatgaaacatttgtatgtgacctcatagtttttttcaaaaaattacattaaaatttatttgtaaataggcccccaaaaatatttaatttgaaaaaaaccttaaattgcaaaacagtttatactccctccctctgttccatcaagattgatgttataggttttttttcttgttccaaaaagtttgatgttttagatcaatattattagtatttttatttgtgaccaatatagagaagagaaaggcagtgtctgatattattaaacaaacaaaagaataataaaaaaataaaaagttatttttcttaatttgtgtgaaaacccacaacatcaaacttcatgaaatagagggagtattaatttcaaaatatataatttatggtttagaccccagattgtcatgaccgaccgttgatactttgcatagcttagaactttcatctctgcgtgtagtagagaatgactagtttggtaacctaatttacttatagatctttaaacatatagatcatttgacccaatttactgccacgcgttttaaatgtactaactactaagtatgaataaaatgatcaatttgagtcacaaaaagtatgtttattgtgatcaattgtgaaatgccaactcttttacaggtattactaggttgatgggaaatattttgctagggtccccgaccaaaccgcactaacaaaaacatgaaatttaattagaaaaaaaaaagttgcaatatttggaggacgatagttccgttgtcaaatgatgaacaacgaagaaaccgtacattgatgagataagttttatgtgaaacacatcttgccacctatatttatgtaactatgtgaaccataataatcataagctctttacaatatattttcttagttttgtttgtaaagcaaatttatggaagaaaaaaaaaattgtcgtccacatatttccaatctcttccactttgattctcttccattcaatctttcttcgaggtttaaagcattttctatgatacaaaagtataagagatgtgtatccagttgcaaaacttatactatgaattgactatactattttgataatttctataaccataacggctgcatgaactatatacttaaaactatgactacgatagtcgcaataaatgtatcgtactatccttcgaactcttatacgatttaaaaccttagcatatcaaacatttaaatttctagatagtgatatcaaaatcctacagccgcaatttttccagaaaaaggtgataattttttttttttatcagcatattgcttcgatgcaaaatacgtggaatctatgcaaacaaatttgtttcttctgtatagttgcttattgagttgagtggttgtcagtcaccaaccctcttcagatctcaaagccacaataaaatacgttaaattaataattaccaacctcaaaactataatctatatatatatatatatataatcagcattttcttcagtgtctctctactctctctcagatttgcatttgtttttttttggtttggtt

SEQ ID NO: 4414 - DNA, 2000 bp, Arabidopsis thaliana
aatcaagaagtttaaaagctaaacttaaaaaggagttgtaactatcagtgtttgtcctgaaatgaaattgtaatgtatggctccacaattatttttgattaaagatattaggaacaatctgttacaccaattgttttctaataaaaaaaacaaccatgaagagaagaagcaatttcttggaaatagtgatcaaaattaatgtttcaatgagttcatatgtaacttcacaacaaagagatcaatcttcgcacgaagctttatctactttgtcggaaacatatcaactaattatagaagaagtttcatggaaaatttgtcatcaaacaaattcactgtaactatcaatatttgtcttgatctccaaatttgatgtatggctccaccatttttttatgcttgtgaggttaggaacaatccgttgtaccaattttcttctaagaaaaaacaaaaaggaagatgagaagtaattcctcaaaattaatgtatcaacatcaaaatggatgggttcacatgtactttcacagaaaagagagatcaattctcacgaagttttatatatgttggcacaaaacaaatcagacgaaccaaatcttttcgatctaattttctcatatttttatatgttctttctcatagtttatctaggtatttttggtagtactatcatttcaagaacttaaattaacaaaaagaaaacaaaacttaaaatgagctgtgaataaagaagtttaaaaccttttacgattgtcctgaaatggaatttttaactatggctccaccattagttttgattaagatactttgaacaatctgttacaccaattttcttctaagataaaaataccaatgaagaggagaagcaatttcatgcaactagtgatcaaacataatgtttcaacgtcaaaatagataagttcatccaatttcatagcaaagaattttattttttttatttttttaagcaaagaggtcaatcttctcacttaactttatctccattatcgaaaacatatccatggctagttttattcgtacattgaagattcacgatagatgactctacctatcctacgttatttttaataatttaaaatactgattttagattagttactaatatttttatacgaaattttatgtttaaataatttaatgaattaaattcatttttatattgacggtaaaataaatacgagagatatgtccaaaagatttaaatttatgttaaaatatgaaactactactataacttatatttataacatatatatctaccatgaatttataaatttgattcataaaataaaatttacaattaactttaatttattgttatttaagtttaatttctttgttccaaacattttttaaatagttacctagatagtttattcctatttattgtttgtactttcatattctgattatccaaattttctgtttcttaatttaattcctctttattagtttcattcatttttctttttgtttcttagtatttcttctagtggtcaccaatctaaaacttcatataatgcagtctaaaaaaggatccttatatgtaagactaattatgtatttatttattattatatagattttatatttatatttatttgaagaaaaaaggactttcaattgttctatttaaacttgaaaactagcttgatgatgaaccacttctgcctagcatctgttaagagctaccagaaaaatcaagttcgtcattttcacaccttttttttttttttttaaatttctcatcgatcaatttgtatggtttacgattacgtgccctctaagctttctctgtatttcatgtgattttaattgacaacttacaagctttaagtttccagtttttcttcatgtgattatattttccttttctcaaacatcgtaaccatacacgtatagctttttcaacgtttttatgttgatctattagctaataattaacattttacgtgaaaaatgaagggtttaaggaaatttcagca

SEQ ID NO: 4415 - DNA, 2000 bp, Arabidopsis thaliana
aacatcagtctgataaaaaaaaagttctttatattcagttaatctgaaaaaactgaagaaacaaaaattacagcaacaaataaaaatacagaaaaaagatatatacatgaacaaagataagtattagtagtacactaatgttttgtttgagaagaggaaaaaaacagaaattagtctataagacaaaagtcgttgagattgtgttggtcaaagtgaaggcttcaaaatcatggtttaacagtttttgatattgactagaaaaatctttgtggaatgttactggtctttaaggctgccaaaaaattcatttatttcattcacgacattaagtggtccaatgtctgccactatcaacattactgattctagctttcatcaataagaaaattttgaaccatataatattcgcattaattcaaaagcattctaaaaatgtagagacagatggaattctacaattctatttaatacaaaagcttacacttttcatttttagcttattctaagctgtcaagtgcttagcattaattgtattgttattatgaatacgtgttttgagtgcattattgaaaagaaggtggagatctcaaccgtctccaatgagtgatttaggagtatatcttaaataatttgcatttttttggtttttgaaattttaacataaagaatcctataattaggttttaaaatcaaaagcaagaacatttctaatattaatgcctattaaaaggggcacatttcaactgttctgacctctaattcttgtttatgccgacatgatgtttgcagtagccagtaatatcagtatttttcaataaactctagctctttaatacaagatcggtaatctaggaaaagccccaattcttacatggatatttttttttgtcatcgtgacgatataaagatgacctaattggcctgacaaaatttacacaaattttattcttacataaactaaaaaaggtgaccaaataatgacaattttatgtgtaatattagaaaattgttattaaaattttcttagcaaatattgacttcgtttttctcaacgatattatatatatgaaattttatgtataagttattacaatcgcatgttctataatttgaacggataacgaaaagcaaaatttagatttcatttataaaataaaaaagaatgaaaattcgaaattcttgtttagcaaaacttttgaataaatgatgtggacaaagcggattaaaccactctatttctagagcggataacaaattacgcttatcaaatttatttctacgtaaaaatgatctgtagttaagctgtcgcagataattttttttttttttaatccgcattattatggattataacttatcaatggtaaccaaaaagcaactcaagccgcaaacggattcgtgcgtcccaagtgtcacaactattcgaactatatatgaagttatgtgtctgttagaactggatttttactattattattactattattattatcatcgattaaaggatgttttttgatgaaaaaaatatattgttctatttagccaacaaaatgaaaagaattccggtccattattttccatcaaatacaaattttaacagattctgatcttgtaaaattcaaattgatgtctcatttcttttccaaatactgaaattggacttaatgttatgtactctcaggtcccccacaatgatcactctttttcacaaatttggttcaaatccactccaaaagatacaaaaacaattcaaactttagggaagtcaaacaaaactataacaaacaataaggaccattttgaaatttctactttcttcagttctttcatggaactttcgttgtaatctatctacaacgctccacatactcggtgtgtacacctgaaaccaaacctctatatatagaacacaatctcacttcccaacacatcaaaccataacttccaaatctcaacagaaccaaaaacaaaagaaacctatattaaagaagaaacaaaaa

SEQ ID NO: 4416 - DNA, 1007 bp, Arabidopsis thaliana
tcttttttcttcttgtttccaggtccatatccaggacaatacccacctcctccatactagagcgtttggcgtttagaatttgacgggaagtggtcatgatgtatagattatagttatggtgttttctagaatttggcagacgaatttctttgttttgttttttttatatcatcttccttgtgctattgctagcgtgatggttaatttttgagttggtcagtgaaacttattgagaagtttggatcttttcatgtttaaccagatcgcagattatattgaattattactctaaatccttggttttgtgtgttcatcatcctcttgagttaaaattatgttaaaaacaaaaaaaggttttggttctgtctttaactttaagaaacggaacttatcggcgtataatcatcgcacttgtgatcagatgcaattagaaaaaggttatttggtcaatgtatagcaatatctttaggttctaacaaaaacattattgttgacaaatagcccaaaagtagtagaatttagccgacagattttactgcactttggtttctcgatctctactccaaatgagtaaaaagtgggtaaagcgggaaacagcaaaagaaatcacacatttaataaaaaataaagaaaaagaaattccacattaaataatcacaacaagaaaaacaaataatatattagtaaaagacaaacgtaaaaaccatctctcggccttctctcataaatcaatctctcttcttatcactctccgaaacccacttccagctttttcctctctctttctctctctagtctctcttttgtagctctcccctgctaagctaaccactgcacgtttccatagagaggaaagatgagtctctctccgagagattttctctctatcatcttatcttcttccgtgtaatgctctgagccaaaacccaataactaaatcaacaacaatatagaagagaagagaaagatcttatctttcttctcattcttgagtttagtcccccaca

SEQ ID NO: 4417 - DNA, 1622 bp, Arabidopsis thaliana
cttctgtaactgagagaccttgggatgcgaagaaaaaaacgatcggagaagagaatgagcaacggatttcttcaagctactctgcgtttgccgctatcatctgttttcgaattccctccctctctacgccacaaaatatatgggccttgctttggtgtcccttttagcccattttaattcacatcaacccaattagcaaccccacaattaatttcggttttcttttttttttatagatttatttaattctattatatttcttctcaaaccattttagttctactatccttattcttgattattataaaaccaacaaccaaacacacttttaacattatatatacttatcaaaactaatattttcgattctcaaatatttttagtttatatttatatgcattgaaaatttcaattcgaaagatattactttctaatctactaaaaattaaagtaattatttatatgacagaatctttataaaaatctaacaaaaaaaatgagttttgacatcccaaaataaatgataacatattatattttcttattaatcattttattataattgggatccaacaaacatcaacattttattctttgaattacaatgtttattataattatcttcagaaaatggtaagaaacttataatatatatatatatatatataagtatatttattaaactaagttgtttatacatatatataccttataagatactcaaaacctataaaaaaatttacccacaaaaaaaaaacataaaaaggataatcaaactacacctgattacgggaaggtttttggtttcatagttctttttatgtacataaaaaaaatgagacccaaatccagtgagatatgaaaagtacaaatatcttaaatgagaaaaagtcattatttcattgttaattataattttaaaaagataaaatataatatgttttgaagatatatcatcaaaatacaatgacttttttcctacaagtatatacaaggaaacaaaagagctaacgtgtggaaaaaaaaaaacaattaaaaagagagttgaatttttaatatattcacacaacttgtaatagattagcatgtttgtctacttcgaatactcttcttcaagtcaaaccatatgattctcacacgcagcctcgctccatacctcacgttataactttaaaatttcgtattttcttgactatgctccatttacattaagtcctgtcatattattgggagaaattgtatcatcatatatctagaattctcatatacactgtcgacatgttatgtattacggtataaagaatattgcaatcctatattattattttttgaatttccaaagtttaatttaaaattaagaaaatgataacaaatccgagtaaagtcaacaatttccttcgaaaatttatgagtattctgctgcctattttctcacacccaccaatcatattgtatgtcccttgaatccaagtaatagctatgaagaataaacaaaagtagaaaaaataataaaaaacaatttaattacacaacatgagatccattcaatctattagtaacttgttattagattatagtaaccactttctgtctcttgttctaccaaaacaaaacgcttcatc

SEQ ID NO: 4418 - DNA, 1259 bp, Arabidopsis thaliana
ctaacaactcttttgaatgattccttcagatcaatctcaatcttttctatatcttatgtcaagctcaaaatcacaaactatatttcatataactctctctagccacttatgctcttaagaaaatcatttatttccgtaaatagttaatacgagctttcgagtctaaaaagggaaacaatggatagacttcatttagacgtaattttattccacaaataataaagagtctcttaatcttatccctttattctcgctttctttactctgcttttgctcctatcctattcctatgctttgtctattcttactttttcgaccaaactaaaaaaattactgtgtcaaatcttctttctaaaggataatgagacaaaattactttttcgaaatcttcttttaaaaggataatgagacaaattacttgttggaagagtgactaaaataggatttgcaggagctaagttctaaaagtgaatagtagaaatcaaatgtacaaaacaaaacgtacaccaaagaattaggggcataactctccaatgttatatcatggttaaaattttcaacgagtggtttccaatataaactaatttactggtctaattctacaatttagattattccttttttggtcaaacctacaatttaatgtactatagtcttttcaagcaagagaatttagctcgaatcaaattcaagaaactcacccaccagaagagagaaaaatcaaagtagtctactttttgcaagttggtccgtgggtgggtgcatttaagaacgagggacattgttcgtgaccacgagagcacgcacgcataccaaaactcaatgaaatgacaaaagacatataaacaagagagaaaaatgtatacacacaaatagaataacaactattcgtgaaagatagaatagaaaaattcaaaatatacaccttaaatttcatgtttctacccacaaaaaaaaagaatgtagaacattcaaaaacttatttttttgtatatttctgttaaaaaacaactgtaatatgaaaagtcctaaaataaaaggtcaagactaaaaatatcttataaaaatctaaaattacaaaacaaggaaaatttgtttatcaaagtttgggataatagtcttatctctttcatccacactaatataaataggatacatacacaacacattacaagaagataaatccaaacttttctttctctctctttcgtttcccattttttctcttattactcatagatcctgattgatctgaaaaa

SEQ ID NO: 4419 - DNA, 1317 bp, Arabidopsis thaliana
tcttcttctttcattcgtactttttttttctcttggggtagagttgttttctcattccttatggatttgttatgttgacttttgaggattatatgtatttagtattaatgtgttttattgacttaatgaggagagtaggtttaggttacatacctcttttgtcgatatgtctgaccaatggatgggtctctctactaattcacacgcgcccagtgtgacgtcaaataaataaaattccgaaaacattttctgagctttccataatttggaaaaaagtgaattgaaaaaaagaacagtgacactcttgtttctataaattggtgagaccgtcctcaaaaccccttcgtcaccttcagtgtctctctctcaagatctagctccggtcatgaagtcgtcggaattccaataccacgaggttctctctctctctccctctctctgcttagagattttagatgtagtagtaatagtttaacaggagagtgaagatgtcaagaggtgttgagatgattgattagatctttgaataaacaaatatgtgtatgaattggtgacaggaatacgtgagaaattcaagaggtgtagagttgttcgcatgtagatggatcccatcttcttcgtcttctcccaaagctctggttttcctctgccatggttgcagttatttccttattatttctaaaagccgctttcttcattacacataataaaactgaacaagttggtggtgattttgtgcaggttatggaatggagtgtagcgactccatgaaaggtttttcattattcttcttccttccaatttatgattcacatgcacaatagtaatgcattagatctaacaaatctccaaaaatatggattttttgtttctcttgccttgatttggcggtgggattttagatttaattagcaagttttttttttgtgttgcttctatcagttctctgaatcagattacgcatgatactgagaaaaaagtcatttctttcactgcttatcattttttttaacttttatattttagatttgatgcattatactagttaggatttgtgtagtgatagtagcagatcatggatcttaaattcactgtggaccttagaacatttatgtgtgtagtaatactccttaaatgcctctagaaagcaagtcatggagggtgttaggaccggtaggtcaacaagtcttactttatgtggttggttttggttggagaacgaccctcagactaaatttaatttatttcatttttttggtctttcctcgtttagagtgttgtatttgatcccttgcaaattaaattacctttctttct

SEQ ID NO: 4420 - DNA, 2000 bp, Arabidopsis thaliana
agagttaaataaggaattaaatgagagcaaatctctttgatatacacctcatatcaatgaaaaaacttaatattggtgtatttgtttctttcgtccgactcttgaagaattaaaaggttatatacaaaaaaaaatttgccctttcacattttctaaagatcatatcatctttgatataatcgtttgatgcatgtttactcattcataaacattttataaaatcttctatattattttgattcgaaatttcacactcaaaacataaaatttccaaggataaccaatgaaatgaatacacaagatataatataagttatcaccataaattacataatcagtatagataaagaaaatgttctgaataccaatttagtttataaatttatttttttcgtttatgatttatcaatggttcagttgagtggtttttaattaaaaaaataatattttgttcaacaaaaattcagaacgatggttggaaaaaataaattaaaacaatgcgtatattggattaaaaataaatcatattatatgattctatttgtccgggatttataaattgatatgatacgataaggtcagtgataaaataaattgataagataaggactttatatgattctatttccacccgttggaatctttggttggctatttattcttagattcgagaatcaattagcgaaaacaaatactagtttaaaaaagaaaaaaactatatgataagagaccgtaatagacgtggtacgttttaagtcaaaggtcaaaaagccgaattatatatttctggctccttccacaacttttggaaaatttccttcgtagttttcacttgaacccattttttaacaacaattcttctacttggattgataattcaaaaggaaactaactctcccatagttaaaactgaatcactgttaaaaaaaaaaaaaagtaaagtaaatatactaaatcaatgtttttttctctggaagtaaatatacaagtttaaaattaaaggagaagagaagctatatattgctttgcctcaccatttaggagataattcatatgaagcaaagaaagcatatcctttggcatattcgataatatatggcatctaatcatctgtataagcttttcatatttttgttagatgctttttcgtacaaatgcattaagataaaattaaacaaaaaaacaagatatgatattcagtttcgtgaaatattaaaagaagtcaaaaaaagggaaaaatgaaaagtcgaattggtggacagtggactcattggtccacttaaaagtcatcagaaccgtacacatgcaagcttggtccattttcgtatgacgacgtacaagttacaacattcaaaaaacttcctaatttacaagtttttgcttatgtttatgggaaatatttttctgcaacgaaaaatcattaagactatatttttctgttggcaaagacttgactcagtccctttttactgcccattagtaatctttggagtgaaaatacgaatttaactaattttctaaaatttgattaaagtctaagagagaaaaaaagatttcggctataaataagttacaactacacatcgaatggactagaaaattttcgcttcttatatttttttaaaaagaaaaaccaaaaaatcctttgaaacttttttagcctgtcgcttctctttccatcgtcttcctcgtgaacgaaacttctcgatcttcttttcttttttttcacctgtttttcggtatcacgagaatactacacttcccactccagtaatacgccactccttctttttttttttgtctcgtttaaatttttataaactccataattttatcttaaagtgaatcttttttgttttttttgttccagctttatcggatatatttccttgattttctccgattgtggtcaatctggaaaattattgagaatctctccctcacttaaccaaaagcgtttttaatcagatagagagagaggaaaaagcatcaaccaaacc

SEQ ID NO: 4421 - DNA, 2000 bp, Arabidopsis thaliana
agaagtcttacagttgacaatatgaaaactttagtaaaagtctaccataaaccgtaaaaaaaatgaaattttaattctggaagtaaatgtaatgcatgttgcctaaactcggacactatgtggtagattttgattggtcggaatatatgatctccgaaaagcaacaatgtcaaagctgcgtgaagaaaaaataagctagaaagtaaattatatacatgtacaataatggaaacatatgaataatattaaggagccaaaatcaaaaatgaccggcgatgattaaggtaataaaagtcaaagctcaacacaaccgacgcttttggcaggaaattcgaagacatatggtaagagtcccactttctcattattaatctcttttctttgtcaaaatttgcaacacaaaacacgtttagagtcaatgtcaacatcaggattcagcagtatggtatacggtttgaagagaagcgagaggtaagtgtctgtgtagcaaatgcttgaatctgcttcttggcatctacaaactacaaagtatcaaaaacatatgaataatcatataataaaatattaattgcaccatgccatcattggcttgagactcaagccttgagtgttagaatcataaatagttttgttacctttttggcatttggtgaaatccaacggtgtttgcaaacactaagagtcaagcaaactccaataacaaaaacataatgatccaagcagtgctgtagaaatagttacataaaagttcatacaaaagtttcatactatggtgacaaatgaaacctatagagacttaggctttattgggcccaatgtttgtgagctacgagcccaaatcaagtgaaagataatgaaactacaaaaaatgtaattaaataaagctctttgtagatttagctggacaaattttttaaaaaatcaatgaaagttaaaaaggacttgtggaaaatgtgacgcgagacatttctaccgacatctgagaagaagtgactgtatatccaataaggaaagagaaaggaattggatcttcgatggagcccacgagtgttcactacgcaccatggaattggttcatatggcccattaagagattaatgggcccaaatcagatggcgcgtgtatctcacggtgattcttcacccaggtaaattgctaatgcggtgtctatgttgtcaaatctgtcgttctcaatgagaaatctccatttttcacgtggttaattttcctgtttataattttttttttttttttaaagtagtatcacaataattaattggaaatgaagggcatggaattgaagttatctaacttccttttaaattttcagaaactgcaattttatttagattcaataatcttttaaaattaggttgtaattattagtgcctcatcagtagttagaaaagtaacaagaattgaaattttcgacttttaaaagtgtttctctttagtggttatggaaaatgagatctttgtagatagagattactccttctgataattcttcaatacagtgttatctacactgtttctttcccgtatggtttcagtatcttgttaaaatacattagcaaatgactttaataaattagcaaaaataagtatgacttagaaaaaaaaaggtgtgtattaaactaaaatgcaagaaagaggactagggaagtgtacaatgcacctcgtagcagggaataacatgttctgatttcccacaaaacaccgtagctagctagctgcttctagcgttttctccgtataaccgtttggtttaaatttctccggtacggtcccactttccagaactttcacggtttcaccaaacgccaatcaccaccgtctgttctcctacttacacgtgtacgtatcagatttcacgatcgtaacccatccaagcgcctatattaaccctgtttatcccgctaccgtaagtcctcatcagcaaacacaaacacacgactagataaactctaaatcctcacagcagatcacgtgctaatcac

SEQ ID NO: 4422 - DNA, 2000 bp, Arabidopsis thaliana
aaaatgattaagaaaaacttaatagtgaagaattccgtttctgttacgagtgaggaggagctctatggccaaatttaatatcaagaaattgaaaatattaaaatgaataccaataaatgtttttcttctctatataatgttggtgggactgactgggaacggagcttcgaatcaaagaagaaagccaactaccaaagacagtgtcggttcgacggcgatggcaaatctaacggcaggagaaacgtcgccgtttcagatcatttattaacgtcgaaaacgagttttattaaaaaaattattttatttgatccaaaacgagatttatttttatattatcaaatcatacgttacgactttttacgcgctttttcaccacacgtaccattagcaaatcatacgttatgacttttgcgtaaaaggtaaaaacttgttttacatctgtctcacaaaacttgtaacttgtatattcattttattgatcaagtagatgtagatccccatcacaagatgtgtgttttattcattatgacgacatatttatgtgtgatatataggataaaaagataaaattagatttatgttggatgtatttgtcttaagtcttttaaacaaagattcttgaaaaatgacacaatgttagatcaaaagttttaatcgatacatttagactaaagacatcttaccttccttcactggttttcttacaatgatttcaatatgtagtaaaataaaatgtgttgtttattgctatatgagactcatgggtctagaaagtataaactataagtcatttggataggggtttctctataatttcacccacgaaaatggattacaatgtaacttcatttcataaacacttttaacaatgctataacattcgactatgtttatcaccgaagattcacttattaggctttcttctagtacatccagagaaaacttcgcatgtgttcgactggagcaatttaaaaatgaatgattttaagctaagtaaatgatttttagtatcttgagaatatggacaaacaaacaaaaagtttgtaaagaatgacaaagaggaaacccatgaaaaaaagatacaatatatggaagctcacagacgatgacggcatgagagttattatgacatacaaaccaatcgataaatctttaacaatttactgaaatatttgactaataatcttttggttttggaataatgaaccgatcgaccgtcatataaaatataaatgattggatccacgtacgttggtggccgagcctctgaaaacgaatttgatttatctattttgctaactaatcacctaacgtagtttttgtgtctcaatggttgtacaaaagataaagtctcaagaatttattaacaaaagaagtggccacgaagaatggaattttgttgtatcaatgaagcataagtagtaccatagtattttaaaattcgaaatgcaaatcaaatttcaacgtgacaacatatgttgtataatagttaatcatagtaaatagcacacattgcagctaataattggatttacaattgtttgagtcgtacgttttgatctgttgtttacaagaaaaaatacaaagatggaaagttctaacttcaagtgaagttcagatatcgaccgagtcagaacacgacacgaggctcgaagacagaggcatagtgctgagttgttcaacagaagcaagtaaaaaccttttgtctgagagagaggctccgagttaggcataagccaaacaacttgacacgacacataacctttgcttctcgtgtagacccaactttttacccttaccaaaaatataaaataaaatatgcaaaaaacacacccactcaaaaattaaaattttaatgaaagaaagaagaaacttcacatcagcatcagaatctctctttctctctctctccttcttcacaagcaaaaaaacaccaaaccatttttctttcttcattgtgccgacacttctttcccctctctctctctctctccaccgcc

SEQ ID NO: 4423 - DNA, 294 bp, Arabidopsis thaliana
tcttgtttcaaggttcgtgctctaatcttgtttcgaactagctatcaccgaattgagatttctttactcattatgtcatcttgtattttcgtggatctgtctgtaatttgaaattttgtttcactcaaatgagaaacttactagttctttgttatctgtagtatgtgacaaaacaaaacacaaaagaatcttgctattggttgatccagctttcagacaatgatgtttgtattaaatattaattaattaaaccctctcaaccaattagaggtttcttggcttagaaaagcaacg

SEQ ID NO: 4424 - DNA, 2000 bp, Arabidopsis thaliana
aggaggtccactagtaggtcaagttggctttgtggtgtcgataacatgagattgaccaaagctgtagcttgaccccaaggccacgagggagaaagatctaccaaaccaaaatcatcataacacatctctttctagtatatagcccaccacaaatattaattcttttaatagttatacaccacaaattttatcccccattggccattgactagagtcgttttcgtctttgacagtggtaaaagcttctgtatatgtgaatttaggattccacctttcttaggtttctcattacaagttgatttaacttcttgacttctcaagttgttgttttgtaatttagtaaaaatttgcttacaagtcatacatgattgaatataacaccggctgctaagcctatttttctatcataagtttcgctttcgagtcaaaatgttagtcaacatgaaataaaacacgtttctttatttgttttgcttattgatcaactttaaaatagtcccataaaatagcaaatattaagaaatttcaaatcaatacattagttgccaaaacccgtctgtgatattatactttttgaggctccataataatgacgtgagatttgtttgtgactgaggaagtggaaaataaagttaagcatgtcttactattatcaaatatcagtttttctataacaaagtatgaatgttgatcaaagacaaaaacaaaaaaaaggtgatccacctttctccaaatagaaaggaagtaaggcaatgaatgttttttttttttttttccattgcatttgcttttaaatccttataagaatttgaaagaaaaatatcttatcaactcttagaggtgatctttgggccaaagagggaaccacgtaatcgaatctgaacttctccgcttaaatgggaaattttattagatctgataaacggccaaaagtgatagctcatgattcttaatatagacgtgcatacagagatgttgttaccggccgaagagcagcttcgtaatcaacggacacaaataaaccactattggtccatcaaaattaatacaaaacgaatgaaaactgctgtgtcataagactaaataattttgtatattattatgatttagatggatgcggtctacaaatttttttaacaaaaaccaaccattagtttgtttaagttacttgaaaacaagaaaaggttcagtgaaaggtgatatataagctattattattatacacagagtaaaaggaagaaatgtgaaaaggaagattaatccacactaaaagtaaaaggaagaaaacgggtcaaacaatgaatcgtctgactgagtaataatatacgtcgctgtcatatattttgtataaccataaattttttatattttttccgacccaaattatttttagttttctatagctagttactaaattaaaggtgatgaatagtaatcatgactttatgtcacacgataaggttattatcacctacctttgagtatatttaggattttccgaagacttggacgacccaactcagtttggataaaaccttgtggtctattctaaatttaattctaatttacttctgattatgtggatttatacacggttaaacatcagaggctgaataataattagtttgatagatctgatagttcctctgttttctttttcttttttgagttgattatactgtttgcttttgttgattattagtccaaaacattaaaagaacaaaaacaaaaaaaagtgttcacgctttttggtcgaccgtaacatactttattgaattttgttaaaaaatcattacacaaatgatattatggatgtgtgtggtccaaaaaaccaaatattgactgtagaatgataactcgtagaagtaactcaaagctcctctctgcgcttcttttctctctataaaaccaagtctttgatcatcagatttatatcaaacttcaaaagcgtcaaacataaagttaggccaagaaacccatttaaaaaaaaagagagagag

SEQ ID NO: 4425 - DNA, 2000 bp, Arabidopsis thaliana
aaaaataaacggggactagattctgtgccggtgatcggagaggcgctttacaaaatttacttaatatggtcacaactcatatgagattagtacccaaaataaattaaaatatatatatatatatattaagcataaatactatatttttttttgttagttcataaattttataattaatttgtgatggtaagtttaccaaattgattgtagattaaaaaaaaaaatcaacaaataatatattgtttagaaatatttttatatgtgagcctaaattactacagtaaatcttttacacaaataaaaaaacacgtcgtgatttggaaaacacgatgatgaggtattttatgatgacaataccacgtttaatattatgataccagatcggaaaaagatgatatgttatgtgttttagagcttagggagcaatttaagatggaaacgtaaataattatttgttgagaaagaatcgactagaagcaatcgaaaaattgatcgaatggtcaagatatgaccgagaagtcatcggaaaagttgtgagcccaaatcttgagagcaatgacatgcaaaatgttttgaaagtgctctcatgaattaaaagtgaaaaaagaaccactctctcgttacatagagggtagtatataaagaaatttacctatctcagactaggaaaccaagtctcgcattggaatacgactttggtttaaacatgtgagctgactgacaaatcgattttatgtgctttacaacttagatataactgaacatattggtattggatgaggttggacgatagactcatagacacaatcgttgtctcgaaaaatcacgagtttctctcgcttaaaggattttttttgatgaagtttatggtgatcccgttcgagaacatcacaattgtttttgaatcaactttacagatccatattgtaactaatgattatagactacatagtttaccaaaattacatttactcaaaagaacagatgcggttgttgatggcaaaacttttttggaatggtagacatcccattgaaagaaaacaaattgccatggtatggaattcatgataatgatttaactcgttatagtctggacaaattgtcatggtagggtttcattgctctttctttgggtagttacctcaagatatctctttgttcttccttgtgatagttccaccttgatatgtacaaccccacattaatctgctcatttcaacattaattttctctattgtttttaaattgtgtgtataagattatttcactaactaggaaaacaatccatttctttgacacatgggctttacttaaacaaaagcccaataacttgtgtttagaagtcacatgatcaaatctcaagacctattataaattaacaaatttcatattgataaattttaaaagatttcctattacaatatttaaagttgctacaaattatagattcttttgatcttttctgatattgtttctcaaataaaatataggaataccaaattacaatatgaaagttgcttcaaattatagattcttttctgattttgtttctcaaataaaatataggactgaactaccaaaggcaataatattcaatgtgaccaacaaaaaaaaaataaaaaataaaaagaaatactcaaatctcataacctttttgactaaatatatcaatttcttctattttcaatgagcataaattacacgcgtcctcagaagctgaatccgatttgcaattcttcaatctcaaccgttagatcaacaaatccggcatcgaattcctccgcgtggtttggtccatttttttaatttgagtattaattcttttcctatttgacaacatgttttattaattattattattattccatttgcattaaaatataataaaaagatgtaagattctctccgcctccttctctctataagaaccgacacagagacgaagaagaataatcactcgaaaactcatcaaatcaaaaatcaaacacagagaagagaaa

SEQ ID NO: 4426 - DNA, 2000 bp, Arabidopsis thaliana
agcccatgtcgtcccacgagaggtccctctggtttttcttttggaactgagtctaaagaaaatgacattttattatatataaaaaaaaacgtcaccgacctcctcctctacaccagctgtgtccgagagcgacggcaccataaaggagccatctcacggtggcgggaccaaacctctaattcgacttatccacgtcagacctgactcgactaaaaccacgctttgaaaccatctgccacgtgtctttcgccgttgttttttatagatccacatttgggcccccattatgatcggcggtttttttggaacctttaattaattagaaacacattagccacactaattaatttaatgttaaccaaccaccacatttaaatatatgaaatcacggcgttacatcacgcgctaaacgggatatcgtatatctcacgcgctattctcattggctgcgtatagtacacgtacacgtcacctgttttctcaaaaatttctggcgagtcaacaaccgtcgggagagaaaaaaaaagttcattttttttatttgtctattttcttctgttttttttttattagttagcttcacaaaatcttatatttatattttctaatttctgatatcagaattttttggagtttatttattttggggatagtttctctgcgattttcttgggcacttaaaaagacatttttattcacagttcgtctttaggcaaatctctccgtttcttatttttcttctcctttcccatttattttctgtgtcccttgtttggttccagagaaaccgcgagaaacaaaaaaatcagagaagaagaagagaaaacaaaaaaaaaaatctgtcttcttcccgtcgtttaacgctttcagtttcgaaagttgtatctgcatttttctcaggtaatcatttcttagcttaaagtttagtgttttataccattttagcataaagtcaccatttttacaatctctgttctttgttatgagctgggattttttagttttggttcaaagttgaagtctttttgggatgtttgttgtatggttgaatgtctgaaccaaaccagtttaagaaaaaccggattttgttttctgggtttaggaatttggtagtttgtttattatgggttggattttatgtgaagtgacaatgatttgtcaagctttaagcacaacacatttgaaatggtggtggtgggtcaagacaatgtttcattgtctattctctgcaagtgtgttactaaacttttggtaaaaatttatgttttcttcgataccatacaaaatcttctgatgtgcctgtctttgtgcttatacatttgtggcaatttggtattcaatatttatatatctgaaatgtagttttaccacagtagtttctctccaaaatgtgtttgttttttatgcttgaaatgtagggtttggatttttgctctattctttagctttagatgtttggttggtaaaaattgtgaaataatcccaaagtaatacagagattttctatatcagtcagaaatttctatttggagaaataatcccaaacttttgttcctttgatagagaggttcaatattggctataatgcgatctctctggcattacccttgaaaattttctattacaaagtaaagtcatttcatgaataatgtgttttcttgattaccttttggtacaactgtcagcaaactaaagacaaagaaatgttacaaaccttttgtttgtttctcattggctcatagcttgaggtctatgtgtgattttggtatccaatgttttcttgttatagcttaagagaatgttttcaaacttttttcaacagatacaatcttagtaatcacacttgagtatttttcttaactggttttgtttcttggcatcttcatttcagggtctatatttctctgaggaattggattcttatagaagttaaaccgcagagcttcttctatccaatagtcctctgagaatcgtcgatatagtttgctgatatagttgtt

SEQ ID NO: 4427 - DNA, 1513 bp, Arabidopsis thaliana
gccgaaccaatattctatcaagggaatggtatatttatatttgaaaactaatatagatattggtactatcattcattatacaataaataaagtttgagggactgtaatgacttatcatttacaagtaatgacttcattaaaacaagactttactgttaacgtgttggtaattgtaatgcctttatcaataacaagtaaaattatacttcctgtctttaaaactgaagtcgtgtgtaatcagactcttaaaatttatacaaaattagttatctcaacttacctaggtttaaatagtttcttacagcatagcaggttagaaaatgagtaagaacaaaaagaattagtacaaatttcagaccacaagggttaaattatgaagggccgtgttttgcgtagttgtgtagtgatatatattcaaaaccgaggaattttcttataaacgtctatttcggtttttgcccaaacaagaaggtataattcggttggacgacaaaaatagacgctgtattgttgatggagtagatatttattattttcgataaatagtatctctttttaacgttacaacaatttctttcacatcctaatatttgtattttgatattttcttctctataagaaaataaacaagagaaatttcacattcatcgtggattttctatgcaccttgtgttttactgaaccaaattaattaattgaaagaaaaattttcacaattcttttctttttggtttaatggttgatacagaaatccaaaaaggtcaaatggttcatcatgaagggggaaaacgacaatataaaatcacaagcttagggtagaaattaaataaattaatacgaacgtgttttacaaggttgagaccatgaaaaacaagatcgtcaactgtaaccattaaatacgtccttagacccacaagccaatttcaattctggttagatgcatgatttgtgttcacagtggttcttggaaccatccatggcaccttaaacattttagtcactaaagtcgtttcaatcttgaaatttactgtgaacaaaagtcatctaaccataattgaacttggcttgtgggtctaacgacgtattaattggttcacgctagcttgacgtacgattaacggccaatattaccatgatccaacctattaccaaaagaaaattataattaacaatcaaacaaccatttcgatttaaatattttaaaaccaaattggtttgggcgattcatcatattaaacacgtgtgtcttgagctagttaaaccctattgatagctacttgtgtagaaaactcatattgttagacttttcaaagcgtatatttagagagttatttgtgaattataatggtgattaaggtgaaacataacaaaacagatgatattgatagatcatttgatttcattcattgactgacttgcacagttgcaccccaggcttggctctataaattaggcggtaaatggaatgattaaaacatatcatttttcacagaatcatagaaaaatcaagaaa

SEQ ID NO: 4428 - DNA, 1410 bp, Arabidopsis thaliana
aatcgagaaatctctaaactttagatgaaattttgaattctgaaatttgggattgaatcgattagtcgcaagaataaggaaaaatgaagagaatttgggattggggtttatgtgggaaggagatgaaacttgtgcgttgggcaagggatcgtcgttcacatcaaaggaaatttcaaggaagagaggaagaagaagtcacggttttagatatttttaagtctttggcccaacagatatttttatttaaaaaaataacattttacgacgttaataaaacatatttacaactttaatggaaatagaaaagtaaaacattttacgacaataaaaaaatattttacaatttttaatgaaaatagagaagttaatataaaaatttaaattaaatcaaatgaatgttgtgtattttcgaatgttaggacttaataagggtttaaggatgtgaaatcttaggaattattattttaaaatcatttcgtcatttagggatcttgatgatgaggatgcccaatctcctatgccacatcatgttgcctaagattagttacatggacatcacattgagcttggggtgagagttcaccataaactaaaagattccagattagacaatccaaaaggtcaacttatcatatctctggaacacttattcaacaaactttgcttaacttacaatgacagattacaaaaacccaaaagatcttttcttaggaggtttgaggaatcctctcctcaagacattctgtaacttttgtttttgctttttatcgacaaccttcttacttagttgtgaatttttgcgctttgatgattcactaaactttaaatacatatcttggaattttttaagtgatttcttcatgcatacttgaaaaattgttagaacatgttgaatattattattgtttcatccgttgaagcggattgagggattgaaactgcaaaatttgaatcatctttggagatttatgctggtattcgttatgttagcattcgaattcaaatccgtttttttagtaccttcaatttgatatattctttaaataattctatactatatactttttttgcattttaaatctcacataccaaatttatattagtcaataaaactacattgcaaactgttcgcctgcttgcatatttcaacatttgtatgcaaccttaagagagaaaaaaaatccttaagaaacataaacgttaatatattcgcatcaagtactgtctagataattgattttctagtcccatggttgaaaagtcatggataagatcaattggtgtgttagtccttaatttgggtcttattagtagctcaattagtttgaccagaagccaatatatatattgacatacatctctcgtttataacaacgaacaatttgcacacaaccacgagactcaagagac

SEQ ID NO: 4429 - DNA, 1419 bp, Arabidopsis thaliana
gtttatcagattccacgtacgatatgttctttaaaagctcaaagattcacacacatgcatgtcctgattctttcggcttacaatttttgagacattacggcttcttttgctgatagaaccaagactgatcaagagtgacaaagatgggtttttataagatagaaatgtaaattgtagacttggattcattagagaggagaagagatacattttttttttctttacatgagagatatgtaaaatggtggtgtgttattttggaagttaacatatgaatttcttttgttaagattacttaaataatgatttaggaatggattagtagtttagtaccgttcattacacgaagacaagctaatcttttgtctaattaaaataaagctgtctacatgaatcgaatccagcgagataagttagttattttaagcgttggttggaacactttacatggcttttcgtagaaatttccccaagttgggttttattaagaccaagaaaattctagtctcctagacttttttttgtttcttttgttaatttagtctcctaggctttttcattctatctgaaagcaaaatatggttatgcaatttggtttagccaaaaaaacaaactaaatttttctagtccggttcatgtaacttcataatcaaacaagtaaaagtcgaatgtgacgcgtcttgccgaacgcaaaaacggaccaggcaagaaggtgtagttagttaattcggttaatattcagctgagagaaatcgaaccggttccatatcttgtagattatccggtttactttccggataagatttataagcaaaacagagttaaagtagtagatttcttctatacgagaccaaatctgaaaacccaagtcaagctacaaaaacttaactccaagcgaacaaatctcctcattcattaaacaacaaaattgttttccgacaaaaaagtgaatatcattgagttactgcgaaatcccaaccgagagtgacatctcaaaccaaaagatggagtctatattaaagagacgaagactccaaagtcaagctacaaaatttccaagcaaagattacacagagaaaactttccgaccaaatgtgaatgtttatgaaagtttctgcgaaactccagtcatgtcggatgtacaaagccatacaccaatgtaaaaccgacacgtggaaagctaagattcctagcttttctttcttcatgagtctccaatagccaaagagtcaactccaaaaaaaaaaacccatttttgcattgaaatggtctcatgatggggtattttgggtaactaattagtcctgtctacatcttcccataaattaacagagtaggagcggattaaagaagcaagacgattcaaaagaaaaaagagagaagaaagtccactaaagaaaagagaatagatatagatca

SEQ ID NO: 4430 - DNA, 2000 bp, Arabidopsis thaliana
aatttttaacttattttaaaaatcttccaaagaacgatgtcagggggtcccacattagcgaagacgtgaccggatatgaaccgttgattagagggcaatgcgatctaaataagcggctaagatatcgagtcaacaaccaatctaattagtcattttgacccaagaaaagaaaacaaaacaaaaaacccaattagattaggattagtagatagatagatacggcctatttttattgaacaacaaaacaactaattataaataaaaaggacaaaactagttttccaagtttgactgagatgtcgcttttctcgaggccctctttactggaaatctaggctttctcctgaattttacaatttttcctaccttatcgtttttataaaaaaatattaattttaaattgaaaatttcgtatgaagtaatatattttctcaattcataaatgatccaagttgttgttattttcttagtatttgtaattatagcttatatgtatattttaaaattaaatataaaatttacgattatcaatcgttcgataaaaaatttgatcgttcataatattttgaaaaatagtttagaattaaattaaataaataaaataaaattattatagattttaaaaatatacactgataacattaatataaatcactaatcgacaaatacaatcgtataatttaaatcgttattaatatattggttagattaaaaatggtaatatgtatttttacatgataattgtgaaatttttatttacaaacaaagaaaaatctccaataataaaatgatattggaacatgttacacattaatacattttgagattttctcttgagccgtcgtcccctttattttatgagtttgtgacgaggttgtagagagaagaaaacaaaagtagagggggcgaaagaagaataaaaagcaaagtagagaaaattccaaactaaaagttagctgaaagaattgaattaagattgagagactgggagagagagtttaagtaatactaataattaatacatctttggatatctgttttgctttgaactttgaccactgcctcttttgggtcccacccttctctctcttctctctctaaaatctctcactttcctaaacagagagaccccttatgagttttctcctcctcctcctcctcttccttcctcatcccagaaatttccgatttcactttcacatctccctctctcttacaactctctatccgtagtttcagtttcgtcctagaatttcttttcttgtctgttccaggtttgaactaattacttctctcttatgtctgcttttgattttttctagatcgaattcgtgtttttgttttttcttaccttttttttttttgtgaattttcgcaggaatagattttgatctatcctaagattttgtttaaatgacaactctgatttcaccaattagctcagttcaaaagtgaaatttgaatattttgaaattgaaaatatctatctctaatgataatgcgatttacaaaaaaaaaaaaaaaaaaaaaaaatcatggatgtattttcctggatttattattgtcgttgtctcttgtctttaccgaatttaatctaaatggatgtcttcattaaacaaatcgaaagcgtttctaactttacagtttttcgttgtttcactgttatagaattagggtttatgtaactgtcctttacttgcttcaacttctcaaattaaacttcttttttgaaccacgagatctgtcaaaatgagattttatccacttctactgaaaattaagtttgaattgaacaatttctttagccattgatctaaacacatgcaaataaacggatctgggttttctaaaaatcacttttttctgtatgtagttgtttctgttgctaaaaaaattgtgttttgaatcatttttcagatgaaattgtgagttctccgagttatatgcatccgttagaatcaaagcggtaatcaaaagcagaatttagaggattgaaaaag

SEQ ID NO: 4431 - DNA, 2000 bp, Arabidopsis thaliana
tcgtgttaaagatttaggaaaaatattgtttcatagtgtgcttagaatccattgaactaaaaaaggaatgtcaaagggttattaaatcattgctattgctaaccattctttagttctatgatcattttgtagcttaaacttgaaggtagtcaaatatagccggaaaaagaccacgaatgacatccaatctcgtccatgcacggatcaaactataaacttgcaagtttttttttaatagtgtgaaaaaaactattatgcagccaattacattattttcacgattttctagtttaatcactcaagtcggtatcccatgagttataggaatcaagggaagttgagctagttatttctggttcttccatgaagattctccatagccaaatggtctttgtacaacgattcatggagtttaaaagtcgtggtggatgctccacaaaagtgtggttaaaaagtcttgctaatttatagtttgggaaaaatgtcatttaatcctccaacttttaaaaaatagccattttatacatcaacttcgtatatggccgtttaaaacatgaactaaacgttgattaaattttaaaacatgatctttcgttgaccaggccaaaatagacatgccgttatcagtcattaacggaatttctaacgtccgttatcatccgttaactttattagtcaagttttaaattgtggccattttaaacatcaactttttatgtggccatttaaaacatgaactaaacgttgactaccatttaagacataaaaatatcgttgaccagaccaaaatagacatgtctttatcagtagaacctagaaacccgttaataactgttaatctgtccaaaacaacgtcgtttgagaataatcgaaagaacataaagatttttcccatatgaaatctccatatcaaaaagttttaagtagaacccaagaacatagtttgataaagagataatcgcagtgtcagtaattggaagcaaataaaggtattttcgtttatatatttgttttaaatttgaaattgaatcatggaagcaaattgaagactcattataagattgttcgtcttgtttgagcggttgtagaaatagatttggggaactggggtttcatttagaaaacaatcctgattttcttttgattattctcaaaacaaagtcgttttagggatactaatagagtcgttaacaagtgataatgaatgttataagttcttttaatgaatgatgacaacatgtttattttggcttggtcaacgaatttctcatgttttaaatggtagtcaacgcttagttcatgtttaaaattgccacatataaagtcgatgtttaaattgaccacaatttaaaacttgactaataaagtcgttaacggatgataacggacgttagaagttccgttaatgactgataacgacatgtctattttggcatgatcaacgaataatcatgttttaaaagttagtcaacatttaattcatgttttaaacagccgcatacgaaattgatgtataaaatgaccattttttgaaagttaggagattaattgatatttttccctttatagtttacaggtacatacgttgataacacaaatcgtataactttctaacggtacagaaaatagtaaaccgtacaaaaataataaaaaagggtaagatgtagaagtataaaactaatagtacaaattaaaagattttggttccacttgtatgtataagtgattacatcaaaatggtattactaagtcatcatttagatttgatgaagtttgtattcgtgtcataaaccgggcgtaggtggagttattgtcagtttggtagcgttttacgaccacacataaaaacatgtttataaattgttaaaaaacaataagacatgtcataaatctaaatgccacaagtagaattatcgaaataaagcttttacataaatacacacacccaaactaaaaaagaaaaaaaaaagaaagagagagagagaagaagaatcgtggag

SEQ ID NO: 4432 - DNA, 2000 bp, Arabidopsis thaliana
gggctttgaatatttgatattagtttgcttattctttaggctagggtttccattctttttctcttattttaagagatgtaattcattattgtaattagtttttgattattgaataaacgagttttaagagagcttgtctaaagcctagagaggaggactctcaaccctaaaagcttgtgttcaagccctgcaaggaggatttgcaaaacctcatcgatatcgttatcgatctcgaccttatctctattgcttcttcatcaagtttcggcgttctaaacaaaatccgttcgttaatccgagttctcatagagattttgtgttttcgtccgttatttagcttccgctctccatcagatattacttttgttcagtagaccattcataaatacctgccttggatccaaaaataggacaaataaacatcatttgcatcattttattattcttaaaagaaattgcaaatttttgaccaaattgcaaatattttgtttttaggttatacccaatacccacatactgtattatagtcgtaataaaaaaaggaaaagttgcaaaataagtagaggacagtgagaagttggtaactatatatgttttggttaatttagttatgggtatggagtctataacgtatggtttcgatatttccaataattagcaatcgtgtatcttcgttagcatcaacattgttgtattttatttagtgcacaccttctcataatttctaaatcaataaaattttaatatcattttatcttggtatatgtcactatgtatgtggttatttttatgcttccatgtttttattttttttgccatggaaccattagcttaggttgaaaatcatcgattgtaaacctatcatgttttcatttttatgaaatattaggtgatcatccgcgctacaccacggttttttcggatgtttttgtattgtttaatttaaatataatttttatttatcttatcatttactcatgcaataagcaattacatttagtattaaaatatttttttctaaccacattctcaacaatgcatcatacacataatttctaaacaatgtttatcttaaaccaatttaacagagggtagtgttggattctataaacctaagaatttaatgatggagctccttacatattcttcaccctcagttatttattatataaatatcaatttaagagaatataaacatcaatttaagagaatataaacatcaatttaagagaataacttagttaaattattaagtaatatactcatactttgagtttggattaccataaaaatcttcgagtatgagaaaactattaaaatgattttattaaaaaatcatgtgatattaaaataaatttagtaaaagtacaattaaatatgtataataaaataatatgtaaaattaaatataaatatatcattaaactatagatttgaaattgaagagattacattaattatttaataaacacatgtcaaatgctaaagtgatgatgtgtctatcatatgaagagagttggccaactttcatatatataatttacgaaaaaaaaaaaaaaaaacaaatattcaagatctctttcttgatatgggccaatttgatacgaaacattttccagccataacctttcgttttactttatacgggctataggcccattatgggttaacgtgtaggcccaataaggtgttttttcaatttggtttgcatttggtgtgtgtgtgtgtgtcagctacaatttctcaaggagaggcgcgtgtaaatcaaacggataatcctacggttttgatgaaatggcttctcgtagacctcacaatctctaaacatctcttctctttatacgctcttcttctagaaacctctcttacctcactctccttaaacctttaatagggtttttaggttactctttgttcaactactacaaactcttttctctttagagattgagagattgtaaaaaaatctcaaatcttttccttcacaactttcaaatcta

SEQ ID NO: 4433 - DNA, 303 bp, Arabidopsis thaliana
agttgatggagaaattctacaaaagtttagagcttttccctttcgagaacaaacgacagagaagcaaaaaactcagactttactggcttcagttattgcaacaagccaacaaccaaaacgggtcaaaatcaaaatcaatggttggtaataaacgacagcgttttagtacagagacccgaagagtggaaggttcaaagtttccttctttggtgtctctcatcaaatgagagtgagccgtacgatttctctcctcttcttgttttaaaaacctatcaataatattcttcttcttcctcctctcaa

SEQ ID NO: 4434 - DNA, 692 bp, Arabidopsis thaliana
cccggtgtttacattactatcagacaattatcagatgtacgtcgagtcagattcaggtataacaaaacatcttaaactaagcattggctaatcatatacattttgaaagttgataatcataccgtgactaacaggaatctatgattttgtggtttaatcaacagccgggaacagtttggggaagtgcatgttaagacatggtgggagcagaacagagagagaatacaaacacagtacctctaaaaagaaacattatgagcttctctaccacaatctttaattaattaattaatctcattcacataacaacacaactatatacattttgcttatcttttgttcatcttaattagcttaacatcttatacataaatcaagtgttctgaagtatcatctctaatcaaagctgattacatataagtataattatcgttaaatgctctacacgttttcaagtaatgtaaaccatgtcttgtttttgtgacacaaagataaagaagtcaactatgaacctaactattctttaattctagctagatctttctcctctttgggggtttaaaaatatcaaatgttagttcttttatgatcaacatgtggtatagaatataaaaagtcaactttattatttgcttataaggaatacaaagtagagttgaccatttgaggttttagatgagcaaaccataaac

SEQ ID NO: 4435 - DNA, 1659 bp, Arabidopsis thaliana
caaagttaattaacatgtatgtctatctctctccctctgtctgtttgtgtttgtatacttttggtttatatatttaagcttacccttttagttagagggaaagtaaaccacgtttttagtacaatcttcgtgtgaatatattatatgatgctcttatcatattcaatgttatctccttggtacctagctctgcttcattcttcaatagtaagaatttgtcaacaatgacttggaagtggaaacaaagtatttaaatggaccaaccttacctatgattatggattatttaccaggaagctaccaaattgtgacgtccttaaaaacgtgtaagttgaagattggttgatgactttcccgaccaaaccaactccaacttgaaactaaacaaaaagcaaaacttagttcaacgtctttatttgactccgccaccttcagctccatcaaaccggtttaaaccggagccaagtctttcagttgcacaagtcttctttaatcttgatgacctctatttaacgggtgttattggtttctaactttgaaagagttttaataattttaaaagaatataaataatagataaaatcaaagattttaaatgattattagagagttttgtataatctctttgattagcttttccgtaatcttgtaaagtcttcctaacttaaaaagatttgaaatgattacttgagattttatctatttgaaatattgtttctttcatattttataaaattgtctcgtagaaaagttctacataggttttgtatatgtcaaaagtgtactactctcccaaaatattttactgtgcttttgttaaagtttagaggtacttaagttctcatataaaaaatttacacatagttcataattatatagaaagattagagagagggtttaaaagttacgttcatgatatttcttgaaaagattagagagatgtcataacgttacatagattggtttttatttaatgggtaagaagatgatccatgtcaattctaaaaatcattcacaatctctctattcttatgatactttttatgattttattttgtgaagaaaaatgtataaaatcataaaccaataacacaataatttaaatcattaacaatcctaatacttttgttttaattgaataacacaaaaaattcaatgactttactaaagtatgaattcaataactccaaatttataaagattttagattacattttacaaatcagaaactaataacattaaattttaataatcttaaacaatcttaattgaataacaaatgattcttcctaatattataaatcattaaaaatccatataaatcacaaaccaataacatccataagtttgaacgtgactaagaccaatagatgtttccattggaatcattcaccatttttcttcttaattaaaaactagaaaattgacaaaagacacgcaaacgattccaacgacctctcacccgccaacacaaaacgcaaacgcagacctcgatttatatatcttatatttaaaaccatcttctaaacggctttacctgttttttagctttaatctctcttctctctctcaaattctctcctaaaatcctaaatattaccttctccatttgtttcttttcttcttttttgggtggctacctataatccgaaaaccacc

SEQ ID NO: 4436 - DNA, 1570 bp, Arabidopsis thaliana
ggtgagcatgatgatgatgaagatgatactgggtttcagatttcagaactctctgtcactctctttatggctgctctctggagaaatgatagtaaaagtttaggtttttatattgttttgagttgatgtcctgatgttacagcaacggtcggatttattatttgaaaagtgtgcttatggaaatggggaatagtgtttggaaatgtttactagcttctgtatcataaatccctaatgatgggacttaatctttttaaatatttttgtttccttctaattgcaatacagctaagtagagatagtgggaatatggaaagttgtaatcttttaagagaaaattaataaaccattctacaaaaattgttcttggtgcactttattaagattacgaatattaacatttaaacaaatttccaatagaaatataaagtttgacttttgagtaaagtttagggactgtccataagattgagagtctcaccttgtcaaccaaattaacaccaaatcccttcacatttaggaggatgtattcaatatagcatttggaatgatttgtattaagatgaaaaatatattttattcaaacatgaattctaaaaagctttctaaaatcaagtgttattggattaataattttaaaatctagaatcaaatctgctgttattagaaatattttaaatagtggatttgaattgacttgagagattttgggtgaaatttcaatgaatttttaaaaattcaaacattccctgtctcatagtttgaggtagattttaaacagttttaataacaaattttcgaattcactaaaataatttcaaaactcaataaaactcaaatcactccaaattctttctacaatacactcccttaatttttatttttttttcttttttcctatttttttacacccctttattaattactgtgctttactaaacttaccacacatacaaaaatatgaaatttaagttactaatatagaagaatactgttggggactagaatcacatgatcgttgttgtcataaaatctatcgctagttaaagtattaaaagatcgagaaaaaaaattattagttccccaaactcataattgtatgttaacattttctacccattttcttagatttgaataaggaaaaataatattttggttgtaaattgtaataactaaattttttccggatttgattatttgttttattttcttgacagtggtaactctgctcaagtgcttgccttcatctataaaattggagagacttttcattaattactgttccaacaaatttgaactacttttaattatgagtctaattaatacagagagagttcaagcgtccaacgaattaaaggtctcgttgttattttctcactagctaaaggaaaaacttggccacgttgatgaaccaccacttgaaaaatcttgaagcctccatttacatcaaaacagtcaaaccaaattcgcaatctcacaagtttcccttccatcccaaacaacactttattatctcttgttatatataaatctcaaacaataacactaacatttctcaaaatcaagaaat

SEQ ID NO: 4437 - DNA, 2000 bp, Arabidopsis thaliana
tttgttttctgattaatatgataccgatcgatgaaattgttgttttaaccgatctgattaacatttgggaaagaggatcctctcaaacgagaacataacataacagaacatcgtcatcatcatcatgtcatgttaccatgtattttttatacttgttaaatattttttggtctaataaattcatcatttaccttaaaaattcttttttaccatcgtatacagtttttcagctgtttgatagtatttgattaagattaatattaaattgacaaagataagtaaagaacattattatgcaatatgcatgattaagcacatgggacattctgagttttgcacaaactcacaagaggtagagatcggctttaatacacttcccatttattaattacaaatgttggtaagcattgatgtactacacaacagaaagagagatctatcatctcatgtattagtattatcaagagaatgcaataattatttttgtttttacttaataatcataatgtataccaaaataattaactaagggggtgtaaaataagttacgaatgataatttaaattccatatagaaaaaataaacagatagtaaagacaaaaatgctactatgttaaataaactattggtcccatctagtatactgatacattagttttatttcatattatcagtagttttttctattgtttatataaaacaatacgtttacaataggaaggcaggaaaataaaccatatggtgcacaaccattgtagactcaatcctgacaaaacccaataaatttgaggaactccctcaaaaattacggctttgttcaaattgaaaaactggctcttacgatcttagtttggtacacaatcacgtctgatttcccaagttctacttattcacctataatgaactataaatataatctgtaaatatcaaaaggtgggcttaactaggccttgggaaaatattgaattatttaaccttgtatgaatctgacaaactctgattaaagtcttggttcttactctattagtctaatacaaataaataaacatatcttatttccttaaatgtaatttcattctcttaaattatactaaaaaaactctacttgagaaacatgaaagcttaatttggcttgctgtgattgtagatgaagctgagtgctggacgtgctcgaaatgctattttaatttgagagaagaagatgttgatgagttaacgcgcgtctcaatattttgttggccagtgttacgattttcgaatgttaagattgggctaaaaagggaaataaaaatgtctaaaattatggatctcggttatggaaaaccagaaatatacgtcaaaacccgaacattcggttcgattaaacgataaaccaggataaaacctaaccgggtcgttaaacccaaccgcctccttgtttgagaacaaaaaagaagcttaaaccctttcttcctccgccgcgttctcaagctcaagctcaatctcaattctcaagctcaagccttttcgatttttctctttaaagacgcaattttgctttcgcaaccctctgtgtgatttcgtttccaaacgtaagctctacttttgttgtttaatttccaaggctttagcaattaagcaattaagcaattagattgatatacatagttgctcttagaagcttctctttttttttttttagcctggatttaattgtaaagtttggggattttggaatcgaaattgactgttttggagattgatgtgtttaggaaacacggctctctgaatcatggcgacatcagctgatgctcgggcagtaaagtcgctcaacacttccgaggggcgtaagagatttgtggtacgtgtttgtttaattatatagcacatgtcttttcctttcctttgtaaaacttcctctacacctatcatagagtccactgtttctcctcattagtaagctcacttatctgttttcgttgtgctctctaatatggctgtttgtgctttattatttctgg

SEQ ID NO: 4438 - DNA, 644 bp, Arabidopsis thaliana
cagaaccgtagagtaattaccaagttgaagttacaaccaacttcaacttcactaatgattgctacaagagcttagagctatcacatatgactaccgtcacaatcctgactcaaatcaactaatttcaatcaaaccagaatcataaattacttttggaacaataacagaaccatgtcctaatctcagctagaagcgaattcaaatataaaccaaaagataatctgaatcttacttctgaccatgattttgctcgctagagggtaattaaagagcgaagctttaatctttggaaacctaaggttcctgtaattaggtagagaagatgaagaagccacaaaagaagggaaagataacgtcgccgaccacataattcacagtcgccggaaatagagagggagaagaagaagaaacaaacagagagttataaaacgacagcggtatagtaaaaagctaaggcctaagttttttggcccagtgataaatttgaaactttaggcggaaactaaaaacatttgaaacaataaggacttaaaaagtaatttactatttatttagatattgtaaaacccacacaaaaaccctaatttcatttctccaaagctttccagaatactctccactccttcataatttctctggcaacg

SEQ ID NO: 4439 - DNA, 2000 bp, Arabidopsis thaliana
ttgatagtgaattgctcatctagctttcttaatcttagacttggtcaatgttttggcttttctcatactaaaccaattaatacataaaatatttaatttattttctattacaattatctagatatttttagctacacgtgattgaaacgtgtctcaagctacaccaacgctcttcctcacaaactgaattcgtcgtcgatagtggttgctcttgctatcttgatgtttacttcgtctgatcgttgaactggcccgctgcaacattctgagtgttccaagtgattattctagttgtgcgtaacaccgtaacagtaaaaatgagctaaggaaagcgagatgcaagggagaaccaacagaagcataagtttttcctctgttattactaatggaaaaaaactttctttttcattttctaattccttgtcagatttctcagcttctcttctttttgttttgtgtaagacttggtcggagtcttagattacgctgatgattaaaaactactaaaaaagaaaaaaaaaagaatattacgcaaatgttctcgatgcattgaccaagtcctcttctggttctggctccattttcacatgcaggcccataaccaattttaacgagatttgttgcatgaaaagccgattgtttttccttggcagtaacgaaaaaaaattagttactttttaaaaactagggttttgaataatatcattaaaatcaaatagaacgaactagggttttggcatcatacaccgcctcattcaattattaacaaagctgagtcttcttcacggagaaatcacggctgagctaggtctcatataccttgcatcaatatcttgggcctttactaggatcggagatacatcaaacataaaatacttctcggttttattttctctttccttatgtatatgtgaatgcctttaaaaattttgattgccttttttctcgttttggaatagtcatgagaagctgagaaccaaaaaggaaatatttctcacctttgcaactagctagatggagcttatggatgcaaaattcgttttaaaacacattgtattcggatgatgtcaaaatatttcacattcatatagcaaattcatgtttatatattccgatattaactttaaatattaaaacttatatgctgtagattcatatccgggtgaaaacacgaaaggacttatgatggaaccattatatggaacgacgtcatgtggaatatcaagttatttaacttctcgcgagtaagactataaaaagtaatagaataattagtaactaacaatatcagataacgataggcagatgatttggtaatactattttagtatcactacatcacaataaccatactagcatatacgatatacaaattaataaattatcgtgcttaaaacaaaaacctattatcaaccaataatttcttcgcatcagtggcgacaattttttcagccccagaatgattctttgaagaatagtcaacaaagattcctaatttcaacaattctgttcaaggaaaagtacgaaacaaattctactgctagctagtttctctcatgtatatctaaattctattactagtaattaagatctttgaaatcatgccaactgctacatttattttctcttgaaaatcccaactaccttttttttgatcaaaaaaaaaaaagactttagagttcaaagcttgaatttagagttattatgttttaaattttgacagttttgataattttcttcattttaaaatgattttatattttccgtaatttttttctatatttcatatattaaaaaaataagtaatggattagtagctaaacacaagaagttggacaagacccgacaatttaatacgagacgcgttgaccttgaccttgacttttcgtcagcacaaaacgttatctacggtagtcactgagagagaacaaacaatcaaatttgtttcatatatcactcaaagcttgatgagaagaaacacagatcaagaaagcccaatt

SEQ ID NO: 4440 - DNA, 2000 bp, Arabidopsis thaliana
taaagaggggcatacatgagcaatatccacgattgcctaactgtgtaaaacttgcgtcaatgtacttcacattcctccaatcactttggaaatgtaaaatgattatcaataaataactagagaggaacgtggtgttcatgagtcatgtcctcgtcgtcttccacaaacgcatgtgtctccataggtataaatcagaattgatatagtacaaaaaagactcttaacttattatatattgagtgtttgactctacgtacctacgacacaacataagtatttgcaatctcttggaactacaaaagccgttattgacttattggcccttcgccatattcaaaggttcttctctatgcgtgcgcctttccctttctcgtacgtatatataggagtatagtttttaaaacattttttttctgtcgtcgtctattttttaaaacatttatttatctgcggcgtagagaaaatgtaaaagggaaagtgatttgcaaatttctcagtggcgaatttacaaaacttctgacctaataagagaaatttctagctcacatcatcttccacactttgtcggaataggtctcaaactactaaaagtattacaattattcatttataaatacgatatttctacctgcaaagcaaatgataatttaatggactagtgagtattgacactggttcagtatttggttgatattttggtttaatgtagaaaatacgaaagaagaagaagaaaacagaatagtgatgtaatggactgatcatttaacttagataacgatttcataaaataatagcaattccaaaatttgagaaaattatcaatcaactactacatgtatttcttttttctaatggtcaggattcaggaagaaaatctggaagtgtatcttcgctttctgctttacgattgattaaatatataacatttcgaagagttttctactaactgttggcaacagtctgttgctgtcggttccgacgttgcaaacttatccaaaacagcatttagttctgtgtaccgtacagttgaactcgctggattgtaacatgcaaagttacaatcatttttttttttaattcgcctgatatatgacctgattagattttagtttttcatagaaatttaaacactaatctcatcattttcaaactaattaataacactagcttacgagactccggaatccaaacttttctttctttcatattttcttactcccacaacaatatcaccaccatttctcctcgtactgttttgtattttatctcatttaactttatcatctttaaccctttatcaaccatgccaaattgcaaaatatttttttgttttgtttttgttgttatcccatttcagttgtcaattagaagcaatgatacaacacctttcattcaataaataaacaaaatttgatggtagccaccaaaataaaacttgatgacgccaagcgtgtaagccacaaccacgaaaaaaacccaacaaataaacataaatgaaattaagtcaaatgaagattcgattagattttttggacaaaatctgtcggatgcttattcatagcatctcctctgttacagcaagaatgaggaagtacggatcaaagagtgtttgaatggttgacctgaagaaggagaagcaattgagcttaagactctctgattcttttcataacataagtcaagaaaatgtcattttcaactttttggtcatgcatgcattgccacacacagagggagacacatgtcttttgatactatccacttggttcagaaaaaaacaaaaagtcacactttttgaaaaagtgaaaacgtctcaagatatggtgaaatctgcaatctttttttactgtctttttgttatgatagataaggaatctgcaagaaccaatgatcactcttttcactgtatcaaggacaaaagaaagagagaaaacaaaagagttatacagagagaaaacgtgaatagagagatcactgtacttattgggttttgatctttg

SEQ ID NO: 4441 - DNA, 717 bp, Arabidopsis thaliana
tcaggacaactggcctagtgaaaatacaccaagtccaagcatctgaggtacctggaaagatcaccgttgactctttcgaactaggtattgttcagtgacttgtgtttattttcttaacaagacacaacagcgaatgatgaacatctctgagggcgcaattaggagtagattggttggcaatagggatgttctctaccaaaaattttactgttttttcgcaagatttagttatcgtacaattatgtaaaatcattatcaggaaatttgttgcatgattgtgtttgaggtggaaatgaaccgcatccgtattaagatcatttttgctggtggaaacaatgttaccaggaaactgaacttggttttttatagattaatgtgacttgttaggtaccgtaatataatactagttggctacgacacgtacatgtgcgtttattgcttgaagccaataaggacaaggtggacgtaataaagtgtgcttgttgttggatggatctgaatatgatgactcaactgtccaactctaatgttgttgctaaagacccaaatcccacccacatttaatgttgccgtcacggaaacagttttcccaactgtcctaaatcagtgatacccatgcctattctgaactcaactctctttcgaaactcaatccttatataacacatcccatttaagcctataagctacacatatcagctctctcacaaaaataaa

SEQ ID NO: 4442 - DNA, 501 bp, Arabidopsis thaliana
aacaattgtcgtgtaaagagagataaaaccctaaacctagaaactcaccgagagttcgaagattgtaaatcacaatctagaagctagttgcgaaacagaagaaccacctcgaagatcctgagatttgatgatgatgattgtgatgatgatgaatgacagatagagaagacgatgaaattgatttttgattcgatttccccaaatggcaaaagaaaagttccttacctgtaccgattgaccgtaccaactaccaaaccaacgaattgacttttacaaaacttaaaccgaaattaaagataattaaaccgagttattgaactaaaccagataatagcttaggttgaatcagttttaaaaaaatttgcgatacctaaggcccactaagtttttcacatcgtaaaaaggcctaaaataataagcccactttaatcatctcctcccgttatcagattaaaagatttgtttctccgagagcaagaaacctcagagagacgaagcaca

SEQ ID NO: 4443 - DNA, 2000 bp, Arabidopsis thaliana
atttcatccataagtaagtttgtattgcatttgggctactacagaaccaaaggatacattattaggaataggtggagagagacaaaaaaagagtattactggccttcatggcctctttgtgaattgtggccttatatattaggtaatcaattggcccattccaaagaatgtttcgttcattcttatacattactactacattgctaagtgctaagccccccaaatagcaaattctagaataacttttacatgttttgccacttttttattccgacaaatcacgatttatccataggaaaagttgccaactcacccaaacaaacgctaacatccttagaaattaagcagttgatgatcattacatgtgtttttggtgtcatatgacggattcatcaaatcatgttagaatgatgatgttggaaaagaaacacgtaagtagatagcattgattgagatctaaaattgcatttagtaacgaagatcccgtcgattccgtcgtaataactaaagcggtgcatggcaatatgtatattattaatattcattgaggaatgaggaactttcctacacgtaacgaatatacaataatattcctagttagtccaaaatgttggataaatgttcattcatgagttgtgaaaaaaagaaactaaaataatttcaaaaattgttagtattattataattattttttaacaaaatgtttcggttggtgtcatattcttaaagaaaaaaccaataatcaccattacaactaattaagcttaaaacccataaatcacaaacttttcaaaggactgacttccttctaccgaaattatcggaactcattgatgacataaccagacttgcttttgtcgaatgtacctatgattacaaaacatgacacattatacattcacacatacatgagttttggttatttccattatgatatataatatcacacttcaaataacagactttttcttgtttgtctttttcttcaatctttgctaatggtgcagaatggtactcaagcacgtgaaaacgcagaaactcgtatcatccgcttcatttccacggtacaccctcaccttcataactccgatctgtgatctccaccgtccaatagcattgacttcagctcaatatttaatccggcggtccaactattcaattcaagatttaacagaagcatgtgattcttacctcctgacagctcacacgccgcgtttcaaaacaccttcacttgcggacaatacggagcaatggtcgatgtactcttgacccaaagaaggcccaaacatctttaaataaaattaattgtaaactttttgatgagtgagatctaaaaagagtaaaaagacagagaatcttatgataaatttaatatttgttttgctattgtatataaccaactattatgacatagtttgcaatccaaggtgttacaccgaatcggtaaataactaaatactagcttgctcaatctaatagctagagctaataagaaaaatgtatttcgttaggataaataaaaatatcattatgtttacttgaatatttgaaaaaaaatttggtacatgtaaacgaaatttcccaaacaatattctaaagtgtgaaaggatttaaaaatgacgttgactttaggaaaaagtctcttcagttttagttaaaacatattgttaataatgcaaatcaagctcgaaattcaaccaaaagtttataagtgtaaattacttgaaaataatataaccaaataaatttgatgattttgataacattcgaggatatatgttactacatttacgtattttcttaaaattatttcttcaatacaaaaaaaaaaacatattaattacgtcggtgccactgccactaatatttaagagggcatcattaatagattctccattccaaaatcctctgtatatggatctacacctctcctcagtctcatactcaaatcaataatccaaaccccaaaaaaaagaaaaccagagaagagagtttaaaaa

SEQ ID NO: 4444 - DNA, 598 bp, Arabidopsis thaliana
aagaaatttagttcttttatttgtttctttgttaaacactatcatgcaattattggttataaaatgttacagaaagtgaaatcatttttttttttcctaagtgaaatgcggatattgttttatgaggtcagaacatgtctaaactcaatgataagattctaaagtagattgagacaagtttcgtagtcggcagcagtaaccaagaaaacgagtaaggttgactcttgacttgttaaaccattgacttcaatttcgataaagtctctatgtaagctcatttttctgaaacaagttttgctaaaaaaatccaaagatctgaagcttcagatccttctcggctaaggctaagtcacaaccttgtaagtttactttactttggttagatttgtttcaatgttctaggattctacatgtttcttgagaagatatggattagttaaagaataatccaatcttttggttattgagattctatagtcgttggttgattgatttttggaaagttcaatctagtgatgatacacataaccgattgaattattgcttggttatagtttaccaattagagatatttcttgaagttgcagggtctgagtaa

SEQ ID NO: 4445 - DNA, 941 bp, Arabidopsis thaliana
tatttgagatgtgagcgataggagcttcgactctgtcttcgaatccatagagatgtcgagagaaagattatctgcgtaacgagtagatgatagattttgactttttgaatatgaatgtaaacttagtgctgctctctacatcggtaatattacatctaatgtatatacaagtaataccgacaatctccaagcttacaggctgtccaaatttaaagcactaattaatgtaaaacttactgctctcattattaaaaaaaaaaacactagttaatgtctctaatggaggatatattactactaatagtaatatactatacaattagtatttaaaacaacaatgttctatacaattagtacagacaatcgttagacaatcttaagcttacaggctgtccaaatttaaagtcaacgagatcagatcagacttcttaatctattccaattttaggaatcttccttaactctaaaaataatgaaaacaaaaaacatagaaactcgtattccatgcaattttaggaatcttcatagccggaaaccgtaccctaattttttttggtgtacactgttgtttaagctctttggtaattagacttgcatgtggtacgacgacttccggcaaaatagagtaaaattgaaaactcttaaccactttattaacaaaccggaaattaaaattggttacaaagttaaaaactaaaccgaaactaataaactaatcagacaattggaccgaagtaaaatcatctaaccgggtagggtttaaggtctgatgaatcttattcaattttgaaactccttcacttccaataacacttctcgaccatctgccgccacttccgataccgtcatcactaatcgacgagcttccttccgccgccgccggaaacctaacctcccagcgtctgacctatattaatctcactcccattgagccacttcca

SEQ ID NO: 4446 - DNA, 741 bp, Arabidopsis thaliana
cttcttctacctactaatcaaattccaaaatatctactactaatcacaaggcaggacgaaattggaaaatttctactagttttgatcaaagaaaaaaatcaagaacaccacgaaaaaatgtaaacaaatcatagaaagaaatcaaaagaatttcgattcgaaatacctttgggagagatgtgtgaacagagatagagagagagagtgatcaattaaaattcgcaatgcctctgtttttggcttgatcttcttttgattgtgtgtgtaatcggagatagggcttgtttggtcatcttcgtttcccgataaacagacaaaacacgtcgttgggtcaacgcactcatctcttcaatctttcattctaagccgttgatcatgttgactctttttatgtgtactgtgtacaccacattggatcatcctctcccactctgctttcggaagttgaggatatttcgcgcgtcccaaccacgtggcacacatatctaggacaacaagattgaaattccacgtggattttttacatttatttggggcaatagcactcttaaagcccaataatgtttcacctaaatgggctctaaccttggccttaattattaacatttaaaccgctctttatttaaccgacaaaacctttagtcgtgtagttagggttttacttactaatccgccattcactttatttgtaatcagaaactgaaaactaaccaaacataactgcagtctcttcttgtttcg

SEQ ID NO: 4447 - DNA, 2000 bp, Arabidopsis thaliana
atgtttcactaaccataaggtaaggaaataaaaataaaaatgaaggagtgattagttggagccgtaggccgtagggaacttcgtcgtttctcgtagaaaagagtgtagggacgacaagagttgttgtgaaatggacgactgtgatcgttaatgtgactctctttgtccaatcatgtgttagctgattccacacgaaacatagaccttatcacactggaagtttacttgacacatgtctctactcttttattcatcatcactcagaccttactgtttggatattttggtggattcaactttgtcgtttagtctcattcatcggctctctcgcgtgtatcgcacgcaaatagaacactcaatggccaaatcttggaagcagtcaatggccaccaaccttcaataaattaccactaatcattggatagttctaagaaatgtctactttcatatattaatgccaattttaccggttaaattttgacttgacaacaaaagatttaacttttcttatgaatacaaaatcaaagaataaatttaaactgaacaattggtatacgagatagagaaaccaacttcgatcaaagtatgagtaacgaagcttgatcaaagtatgagtaggttaaagttaaattacttttaacaaggtagagacaggagtggtcgtggatataggttagactagtctaagtgatggagcttaattagacggttacgaattgttttgcatcacattcctaataagtacattagatgggtttgatacaaatcgatggatatttatattgtattgcttccaattctcatattaaaaacatttggaaccacatgcaaaaatttatatgcttgtaacataagtatataatctatttatttgtttattttgtcaatgcttagtgatcaaattaacaaagtataagtatatgtatgtttctataatatctgaaatatttattcctagataatatgtgtatgccaaacatttgatatcgtgtatctgtaatcatgtttttttagcagaagtcatgagttcataccaaaattaatatgcaaattttatgttttttctgatgatgggattaaatttgtcgtacttttttgataagacagcaactataagcttaagtcaaatttctgaaattggtcccccacacctctaaatttttgaatcgtttgtattttttttgttactaaatacaaaataatgtaaaatttaaatttgtacggctggattctcttatccgatctatcgcatgccaatttcttcagggaccacaattagaggaaatcgttatcacgacacgtgtcctccgatatttttggcgccgagtagtgacgtcattattaatggtcccctccttccttgcttttttcccattcgtctactctcctttttctttaacaaattatcttttttttcctccgatattcttcaaaatttgttttaaaatcctttgcagatttgtgtaatttatttacttttgcttggtaccaaaaacaaatagagcaaaaatgagcaattctttttgataagcagaaaaaaatgttaggaacgaatgaagaaaaagtgatgcagctatttccttttactgtcacttcgtaattcgtatcattcttttgccgtcaacttctaccatctcttttttttgtaaaacgataaaactttttgttgtcgctgtaaatgttagtaatctgacctaatcccaatttattatggatcaccaaaaagctggtactctacaatttaataataaaagaagaagaataaatataggaataaatcgtcttttttggtgtaagctacatataaaattcaaaccgtcaaacacacatacacatcgaaacccttatatttcattttctttctgttttagagaagaaagtttctataattgattgataaatctgaacatcaaagctaagaatttctcttctttttttcttcttaattcatctttccctctccgaaacagaaattcaaaaacaaattcaacacgaaaacg

SEQ ID NO: 4448 - DNA, 2000 bp, Arabidopsis thaliana
acatcaatattttcaattgtacaaaatgaatcagagctttgataataatactattaggatggtttatgagataaaacagtattgaaatttaaattagcaacgatagaaaacggacacaacaacaaatcatgaattatttttcacaacaatttatttattgctaccgtaagaaattgtttgaagtaaacctcagaattaatccatgaccaaacatcaaaaaccaaaatgttaaaattcagaaatagaaaggattggtcgactttcactatctttcttcttcttcgcttgtgttactttgggatgatcttccagtattccataaacacttatttatttaaacgaatgaaaaataccattttagattctcccaagcaaactaaaccaaagctattaccaaactaatttaaaccagaacaaaccagctatatattctctaatagaaaccctatgcagtttcaaagttttttttttttccttttgtgtagctttcatgtagcaaggttaatgtttactagtcatgaattgaaatgagtattgagaataaagaaatatatcaagaaataattatatagaaactgaaaaggatgtaacatatatataaagagatgccacatgaattgaaattggtggaacattaatctataaccgtgaataaggttgctatattcaagacattaaaaatcaatcaggaccactacacatggatgttaagacgaacttaagaagattgtgactatatttgagttttacatgaatatatacaacgatccatcattttttcagaagcagttagcaaaaatgaaaataaattcatcactaactagaaaaacaataatgatatatatataattattgccacaaacatttcgtagacgattttaactgttagaggatgcataatctttttcttcctaacatgttatttctatgtgaacacaagtctataggttgggagagttgagaaaatttaagtttttaggtttatcaaacaaaaaaacgatcaacttatgattttgagcaaacaataacaagtacgaaagatttttgttaggaagcagattgaaaacttttattatcatgttcaatattaaaatcataaggtaacctatatgttaaaaataaaaatttagtcttagtgaattatatctcactacttattacgaaattcataaaatgtagtctagttttagtgaatcatacaattttgtttgtttttgtttctgaaaattcatttcttttcaatgaatggcccatcaacgacaattatccgtttaacatggattttgaagcccagcaatcaatatgggtttccaagcccaatacaaaaagtcttatttttagcaatataaatcagataaaatagggcgaggaaaactaaaataccaaattggataaatcagaaaaaaactagttcctctacgccgactacatcgtacactcaaaaagattggtaccacaagaactgatttacacagactctgctacgtgtacaactattttaccctttagtacacagtaaaaatatacacgtacacacaccagattaaattatttagcgagaaaaaaaatcctgaaaagaaaatgagatattttttagtgagctttgtatataaagccccttaaaccctactccttggcttcattctacatttcctctgcctctttctcagatcacaaaaccctaatttcgaatctttattcttcaggtaccatttcttcaccatcttcgatctcctaagctttactatgtttctgttttgtttaatttcatggtgaattcgtttctagtgtgtctctgttttgtgttctcgtttcaatttgactgtaagggatttagagcttaaaattactcttatgtatactttgaatatagatctacttgttttggatcagcccatctcgttgaattgatgatttagtcttaaagttagggtttttattagtattgatttataacagttgatctgatctgattctgtgtgtttttggaactttgtaga

SEQ ID NO: 4449 - DNA, 2000 bp, Arabidopsis thaliana
tagaataaaataaaaatagaaagatgatagataataaggacaagtggtggtgtggagaatacgtgacactagtttggggttggaggacaaggaaaagcatgacgtgtgaatgtgacgaccaaacacacacgctttatatttaaaagtctcccaagtcacgctccactcacgtgtttctatgtttttctatatatttatttatttgcccttctgttttttctttttgagtagttgaccaagaagatactgctgaaatttacatgatttggaattttcttttagatttccaagttctagttgttatttgttaatatgctgatgaagtgattcttttgtttccaacttatcgtgcctctaaagtctctctcgaatggtaggtgtgtggtttctttatagaaatgatatacaatacaaaaacaaattgtttttacggtattagtttggtgtgattattgattgttgagctggctttatctggtggtgttgtgtgtcttaagccataatctgattgtttttgttttgatgtccagatttctcaaacgagtgcaataacaacaacaacaacaacaacccttttcaagagatcaagaaagaagaaggtaaaaaatacgaaagacagtgtttctattagttactgatactgttaaaagataatattactagttttagaccagacatagagcaactctgaccaggctactacctactggtttgtttaaatctgttgaggcatattgtctaagatacgcctagcaatcttatattttctacatttggactgatatggttttacattttagccgattcaaacctatatttctctaattaatatatatgattgttgacagactttggctgagcttaaagaggaagagatcatgctcttgaaggaaagtaacggcctgaaaaatgtataacctccattttagcctctttctttatgtctctatatatcaagtccaagttctaatcttagatttggttaatcttattcttgaatcaggaattggcaaatatgcgcgatttgctcgagcaacaaagagcaagaaacactgctctaaagaagatgaaggtgagcccatcgctctctctctctctctctctctatctttctatacatgtactcattcaatcatatatacggaagataaacatgttaattattcaagtatatcattttcatgtgtatgcaggctgaatcacaatctgccttatcgtgcaaactcactttcgaacaaggttcttccttcttgctccctgacctaaacatgcctctagataacgacccgagccctgaagttgtctgctgaacgggcgagccacaagcatatcattcttttgtttttcccattacacaacactataccactatacctcctccgtccacaaacatgttttttgaactgtaactatatgaatatgaagaacgtagattaatcctatatatccttcacccatatcccggtggaagctgaagaagattcgcctgaaggtgaagtggttcgagactatggttaagtgtgttaacaatatcttctagtttagctggtagtaagatttttgttctgccaatctcctaaatgattcttatctttctcccattttattaggatgagatgtaattatctacttagataatagatgtacacctttttttttttgtttgttctttcttattatctctggtaagatgtattacatcgacatttataatcagtgtaacacgttccaaacattttactatattttgtattatgattgatggactaaaaaatatctgcagtcttgcattctttttcatcgttataaataatttagaaatttcaaaccattaatactaaaaacacgtaattacggaaaaagtaagatactaatcagattctttattaagctcagctaaaccagtagtagtaaaattatcactggccttaaaaccctagaaatagaattaatctcagctattttgtcttaacgactctttattgtcccgacacacgaaa

SEQ ID NO: 4450 - DNA, 2000 bp, Arabidopsis thaliana
tgatcagccgcaagcttactactccggggtgattaaaagtgagcagcttattcaaattagggttttgcggtgccttttagcaccattttattgggccgtgataattgtctgttgggttatgtacttagtttaggatagtcaggcccatcttttctcttatgttttatatgtaaattttaaatgccaaagggttgattagggaaataatataaaatattggggtttaattgtgaaagtagaaaagaaattagaagaagaagaagaaaaaggagaaaggtatgatacacttttacttacgtgaatgagtttgtgtgacaacaagacaagcgtggattctggtactcatacgatagaaacggttgatgttagagctaatctcaattttcaacaatcagataaacaaatacaaaaacattctctttccttggaaatttacacaccacaattttggaaaaatatataattaaaaatggtcggaaatggaaaggttttaaacttgtcggagctttctcaacacaggaatcgccatgttaagtgagttttatgttggagacatagatctctctaccaaggccagtgatattgctactactactaccccaaatcagacagagcataatcaagataacaagagctttgaattgaagagttctgagttgttgttgattaagctctttcagtttcttgttcctcttttcatcttaggtttggctcttggtgttcgattctacaccaaactccatcatttccatgaaaatcgatttgtggtttgggggcaatcaagaagatttctatggactatggttattggttaacattatttgcttttatatctctctgtattgtctgtgtataagacatcttatatattaatcatgtaagtgacattaccttagtttcttcaaaactatgcagaattggttctagtcttcacagtcatgcattatactcctactgattttccggatagttatagcatgatcatgtgagcataataaatcgataaaatcttggcataaaacatcaatgaattctttattaatttcttataaaattattgtttataactataactttcttatttataatatctttaaaataaattgatttagaaattccgaaaaacataatcaggaagagttttaaactgttagtattaaatttcattttactattttataaaataatagaaatgaaatctatgaaagtaatatttacagatttattctttatcaaaaaggaaaagaaaaggatattttattaaaaaaacagtgataggacgaaactgttaaatgggctggagagatataaaactgttagccactacctggcccataatatatcacatcgtctctttcgctgcacttggtggttctccaattccgtatcgaaaatcttcttcgggtcagacgatctgaagccgatcgctgtagaatcagtttcgtgctccgcagtttctcgagtttcctctcacttcaggtagtcttcgacaccctaatcatgttagattgatattaatgttgaattttagctgatattcaatggttattgatccagatcttcataagagaattcacttacggagagggactttttcgtagacgattctcactggatatctatcacccggtaagatcgtcttgctcgaaaagaattgaaaagtttttaagtaattgaataaggaactgtgaatcggagaggcttacttttttgaaaagatctaaaccatcgtagaagatcgtcctcaaatatctcacagaagttaccaattttgaaagatcactagagatagctacggattttgagaggcggatctgtccaggtcggcactgtgaaagagaactacactggttttttccagatgatatgaagcttccgtgaacgaatctgattctaaggtactcatcgaagagaatctgggattgtattgatctggtcccttagcttccagtttggctataactctgacaactgttgtaagtgataagttgtgatcaata

SEQ ID NO: 4451 - DNA, 2000 bp, Arabidopsis thaliana
cccgtttggtgaaaagtgcagtaaattagtgattttgactttgaccgggatggaaaattgttggtgtctttagttgatttttcaatttcattttacactagagtcaaaatagcactgaatttttttttaaagcaaaaattaaatatgaacagtgtacactttttagtttttacataagatattatataaagttgaataatattatgcggaatttggaaagaatctgtttagtagacttttagttttggttcaacttttcttttttcgtctatatagtcattagatatatttgattcaattttattatatgtgtgtatagcgtgtgtgcatattgaaactttgaagcaagtttgagtctttagacaatctcactttgttgcttttaagctatacatagctcagagtctcagaataccatcaatcacaccactttctgcaataattcgttaacctaaatcgaaaccaaaagtaaaataaagatggttgttttgattctagcgaggatgaaactgagaccaatcacattttacatgtattaagaaactaaaaatatttataggtcatcaatggttatcgattttaatatagttttaagattataatttttggtttttgaattttagattttgggttttagattttccaaaaataaagatatatataaaaaaaaataggaagaaaaagtcacgttaatattgttaaggaaaagcgaaaaactcaatttgaaaactcaattttgctattttttactattcataatactcatcaattttttaaaaaaatgagtgtgtaaaaaatataagtagaaaagtcaaaacggcattaatctactaaaactcacttttagcatccgtaattattttacgaaaacttaatttagttcagttttttctgctaaagttattcaattaattattttgtgatttttgtgtcataccaatcaagaccaaaaacaatataaaaattagtaaatattcaagtccgtaatttttgaaatagaaatatttatattacacttactcttttggttcgtcaatattgtcgaggtaataaagcgtagggtataatgtatgtgtagattttttgattgcctagtcaaagggtaaccggttaacaaggaagattattagttactacaattctaggacaggagagaatgtatttaggcttcacgccacaactactgaagatagtggtgtcgctatctttagatgtgataaacataaagtcgtgtcggtatccttgaaaagttgaaattagtgcgtattagcattgtttatccctaaaggcacatatatattgttccttactttcaaacgacatatatttcttcagaaccttttgctataatatgtctgaataatcattacaatatagtatatacacacaaaacttattgatactatgcattctctttggctatgttggaaaattcacttgcatgacttgtataaacttctaagttatgcatgcgttttaaataatcaagttactactataaattaagatacaggtatgtatagcaattaattaaaaactaattaatacagtttagtaatgaataatgatataaacattatacagtacagtgtcgctgtttcagtaatgatataatattcacatcagatttacatgtaaagattcagatcatagcaaattagcaatgaagtaaaggacaatgcaagaaattgaccaaattacttgaatattctaataattcatttcttttctttttttggttggcgaaacatatatatttggttacgttatatgcttaagggatatactgcttatttttcaagtaatcaaaatataaagatagaattatagtaaggagataaaagttgagattttagtaatagaataaaaatagtaatgaagtaatatttacaccaactttacgtgtaagccatccccacacacacatcaacctcctatataaacctaaacacatacctcaaacaaccaaaagcaaaaacctcatcgacataaaaagaaaa

SEQ ID NO: 4452 - DNA, 2000 bp, Arabidopsis thaliana
aatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattgg

SEQ ID NO: 4453 - DNA, 2000 bp, Arabidopsis thaliana
gaagtcttatacttatagtttataaatcaaatataatatgatcgatatagtcaaaccgatctaatctagaaagcaaataaaacttctaagagatggaatataaaccaggtggatcaaaatcttaagtatgtttttggatctcaggatcttagagaggttagcaaaagcttaacaaatgatgtaaaacggattaaaagtataaaccgttaaaacttaaaagagagagattgagagttactataccttcaagggtttgaatttcttgagctctaatggacatttttctcttcgtctttttttttgtcaaagctctcagatgtttttgaagatctcaagactaaatacaatttggtttatatgtatagacaaaatgatgaccacctgtagtttaatgccaactaatcactgtgttatagtttttaattaatccaatatactatattgcctaccatcctgacaattctgagtggcttgaccaattttatattcgaaatggtttaataacaatatttgttcgtaccctaagattggagtaatatcaccgaaagttaaaataaagtcctcttttacgttaagaaaattagttagagaagattaatagtttcaaagatgattttcatatttacttaggggtctcaattttgtttgttcgtattatataatttctttctcgtgttaccttttatgagtggagatgcattgtacttaagcatatttttattttttttggcggccattgtatataaatttaaataatgaacgcttatacatattacaacattggtagtagcagcataaaattcaattattgttggttttctactgttaatgtaaagcagccaattatatagttttttggtttgactttcactttatctgagaaaacaaaactgtatcgttatttttggatttcacatgacggatccgataattttcaacttagacatgaagatttgctagtctcatgaatctcattatttacaaccattagtctctcttatttaagttcggtctctctctaaatgtttgagttagaccagccaaagattggtgatactgtattactaatacatacatatctttaaaatattttttggtgattaacatcataaattgttagtattggaggtgttagtatatgtcttctgaagcttcaatttggttgaggtgttataggattgtttcatagtgttctgaagatgttagtatgacttttggaggataagaagttgctttgtccatgctactgattggggatgttggtagaaaacagcattgcctgccgcctttagctcatgttgcatcgctccttcttaggttggggctcacgttgaagggattttcgcttcgctttataatcattttaaagtttctttttcttttatagctcttgtttcttgccatgttttgcttagaggaatttttttatcgcgttcatttcatagctttgtctaaagcttcacggcttaaagatgtagtgatgatctaattctcgattgtctatgcttccatattttttaccttttcggcatgggacaatgtatctaggatcttactgatgtcgtttcctaaaccttattaacattacattcttatcacacacaaaaaaacacatcataaattgatgaaatatatttggacaattaaaactacatgttacgggagcaatccaacaaaacatcacaaatggttaaggaagctactcgtaaaactcctttatagcccaatgggccttatatggtgacaataaaaaaagaataggctaattgggccggccgaaactagaaaccttggaggagcagtttctggttatcggctccccacgtaaacctcggttcctcgtcgacgtctccgatcttcgtggtctaacgcaaaaacacacacattatatactttctcgagaaaattcttcaaaaccaaattgacaaaaatggaaaacaaaaaaaaagaggaaagtcaaatccacgattaagaagagtaactttgcacgcggcttcgtg

SEQ ID NO: 4454 - DNA, 2000 bp, Arabidopsis thaliana
agttaaatcttagttcttacttatgagtaaatgtccttagactactcatgttacgatcgatgatgcatgtgtgtgaacttaccttaatggatatacgcggcgaaaacaaagactgccacaaaatctactctttgtgttgttattggtacacatcaatggatgaagaatagtggctcgaaccgcttcattggccagaaaaatataagattagctactacatttttttctaaagtaaaatcaattttgttttttgggatcaatttttgcagaattctatgtagtgattacgacaccacacgcatgcatggcatcatcagagaaaaagattatagatgactagacgcactgatccttctacctttttttctttaaattgaatgattttaatataaacaatttgtaacttgtaatagatttgcacttctcctcctataaatgcgttcgtcaacatctttgctttcgtacggtaaaacaacatctctcgttgaaacaaaatgtgtttgatcattttaaattttctaataccttacgtcttttattttaatttctataagaattgtctgtatggaaagtttttttaagatttttgttgcattttttttaatggacagcttagtcatgcttctctctaatctatagactaacatgcgggtaacatataaatggcttatataaatatattcttaacaaaaaatatcaatattcttttcagcatatcagtgttataattaatttagaatccacgtctagtttatattttcttctttatttgcggccccaataatactacttttggtcaacaatatgaaagtcaaaccagccgctcaaatgtatccttcatgagttcatgttatatttcagtcaatacttttcatatttaaacacttattataattacgtaatatttttttgcccaaaaaaaaaaattacgtaatattcaacatctctaccttgtagagttccaaaacattgtcacaaaatatttataaagaatttattttaactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaaaaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 4455 - DNA, 1192 bp, Arabidopsis thaliana
cttgatattctcaggtgtgcattttgaatcaattaagtaaagacggaagctttctataaccggagctctatgtaatggcagatttttgtcaagaaaacactccaacctcttgcattcagaagaatctctatgaccatacttaagtttaggcaaccacatccaaagatactcccatcttttcgacaaaatgctagtggatacagcaattttgttggaacaaacaataatatcttaataagcacttcatcagataactcactgaatctatccatatcttgaaacccgaaaccccaagttactgttgttactgtcgacagaacttgggaccctaataagaaagaagataacatctttcaggctcataaagctaaagaagccaattagtaaacaagtgaaaactcggacacaaagaggaacagtactaaaccttagaaacaagctagattgttaggtgaagctgagaaattttcagtgcccaaagaactgtatatccttttcaaatctagtagaatggtagtctgaactaggaatcaagaaagggtaaatgtaaacgaagcttgaatggtacatagcaaggaaaaaggaatatgaacaagttggtttatcagaagataccacaatcgctgagcatcggaacgacaaagtgttgtcctcaccgttgatactcacactggccactgacccactcatcaaagcgttcggcgtccatttaatttaggtgtttaattaccataaacgatgggcctggttatgggcctaacttttatgttatacgcccatttaacttgggtgtttaattacaaacttgctttagcgacgactttgacgagaaatgagaggcccaatataaaatacgagcttgcttaccaaaatttgagacccaaatagtaaaccaatctcctccagaatgcaagtggacacaaatccccaagagaaacagaatcaaaatctcaagaaaacctattagccctgtttccagcaagagggcagagaagcagagagagagagagtgtgagagagaaagcagcttcttcttcttctcctcctcttctcccttatgtggatttcaaatccttctctgctactctctcttcacatttctctaccaacattcttcttctgacactcaacacacacactgcaacttccacagctaaatctagcaacaccaagtcaaaatccgccactaacg

SEQ ID NO: 4456 - DNA, 1620 bp, Arabidopsis thaliana
gtcaaatcaaagatagaaatcactttaaagtttttgtttgtcactgttatgttggagtagaaagcgataatggagagaggtattaaagaagggttcccgttgaaggccttttagtgctcttcatgattttgccaaatagctgaaatgttgattcgtctatggtttgtaattgtattgacgccaatatcttcccaaatcatcactcattataattttaacgatctgatgtttaaaaggttctcagttatatatatctgtataattgatcagtagaacatattatttaacggattttatggagatactccggtaacttattaaacagatctcatgaaagtaatcagtgtcaagaaatgtcaagactgtatacatatgttaatatgctaaaccacaacgactatcacttcccaaaacatggttatgatgttgatatgaccctccaaatccacaagtgtgtatgtgtatcaacgtcaaagtattgaatataaagagttgtgagtactaaaaataaaagcaaactaaaaatatagtccgtatggaatgcctttaaaactgcttgtagtggaggaaaatagaaatttggaggacaccaaattttccccctttttttttcttttttttttctagtaaatcaaattaattaatatcataaaaaagattagatgatatataagcatcttttttttttccgtaaatcaaattaattgatattataaaaaagataatggggtgattgacatcgcattgtcaagactttaaaactatttaacaaatgataaatcacattaattgacaccatgtatgttttggatatgtttgataaaaatagtttactagtgaaaaaaaaaatatgatccacacccgagggagtagatttaatttttttttttcttcagaaaatcagctatacattaattatgtattctgacttaataattggtcgggtttgcaaatcttttatttttttggtaaacatgtgaagaaaaaaatagaaggtttgtaaatctttcaatattgtttgtacattttccataaatctttcaatattgtttgtgcttcatcaacatatagtcaacacaaacaatgctacgctcttatgaggttctgcaatatgagtagcttggacgaggtttctgatcaatagatctgttataatattataaaacatatcgattctaacagattttcaatggatatataatccgataactttttagacacatctgatgagtgatcactgtaaaaaaaaatacaaaaaaatcaaaaccatgtgtatatatgctaaactacaaatataaaattaccacacttgtacaatatataataaaaataaacatcataatactaataattacgacactattggtcttggtttggtttatatgcacgactccggctttaaacaataaatccaggagcatgacacttccacgtccttggctagatctaagtttaagtcaacgatgactcatagtggacacgtgtcactcgttcattcgagttatccacgtgacttcttattacagtcttcttgactctttttttttttttttttttttgctgaaaattataaaaacccaaaatccaacaaactttgattacacacacttacatacaaca

SEQ ID NO: 4457 - DNA, 1456 bp, Arabidopsis thaliana
aacctctcaaatctttgcattgtttcaattacagttttgtatgtgagagatctctatttatctaaacatgacttgacagtctgtctttgctagtgttgattgttcacgaagctctaacatttcatttagtaatatattagtatggttcttcataatatttacgttggtgcccttgtataaaaccaccggagtgagcgcaagctttacagacaaacagtgcttctgtctacccaaggcgggccttaaaagcctgaatagtgtatatgtttacttgacaagagcccatgtacactcatgagcgattgactttaaccggttttagagaaaagtacttttacattgtcacatttacatcctttataattaaccttttaatttaggttttaaagatccacctcagcatttattttaatggaatgattatttagcagtgtgaaccgattaactcggtttttgacggtgaccggtttagaggaaatgggagtgtcggtaggagatctaagtagcgagtatgtaaattgtccaactgtctgaaaaggaccacttgggacgacaagattcttcggctaataataatacatcactcgtttcaacaaataaaattttcctttctattattatgcaatcttatagcatatggatttgatcttttttaatatataaacaaaaggttttccaattatgctaaaccataatctgaaattgattttaaatagctacaatcaactacccaaaagcttcaaatatgcaaaataataaagtataggtttatatatataaacgcacacaaaagaggttgaataaaaataaacataaggatgcatgtgcagtccagattagatctaaatctattgagtattgtaataatattgttatgaagatcttgctgcgaaactacacacatttaattccaacatgttttgtttatagaaattgaataaaatcaaacgcgccttcatcttcaagttaaaaatcaaatcttaattagtgaagacaaagaagaagaagacattattttaagtgagttctctctctgtcacactcacaaagctttatactttctggctactgcaagctcatcactgaaaagagcttaaaccagagagatctgataagagaaattttagagtctctctgcttcaacaagatctacatcgaccaggttcaatatttttctctactgttagttcgtgttctagctctgtttcaacgagatccgattctgtgttttcgatttcagtgctaaagttacggtctttgaatctttctatgttaggattagtcttttgaatccataaactctagatttcaattgttaaaggctaggttttgattagtttgaattagctagatccttttttaacagatcttgatgtttaagctcaaagttgtgtcgttatactgagaatcaagtttgtgatttgttgggaatggtttcaggagattagaaagaatc

SEQ ID NO: 4458 - DNA, 1976 bp, Arabidopsis thaliana
tcttgagctttgagttctcaataacgctcaaaatggtcacaatctaaaattagcaaaaagatcaaaactttagtaatactattgtcactttgaacatctttaactcgaaaacttaaaccccaaaacttagacatcatgattttcacctaacgtcgatgcaatcacatgattcacatgaatagatacataaatgcgaaagcaactttgaacatagtgacaaccatagagaacttagcagtcaaataaaggtcaaaattaaaactttctgattcaaaactaagcccaattgcgagatctaggcgaatcctaaaatccacatccctactgtgaaaatgaccagcaaggatcaaaatcaaaaacaagaaaccatcaacagaacatgagttcttacaagacataatgaatcaaaagtttgactttaatttcaataataaacgaccatgtaccgtatcaatggagtatcaagagaaacagacaacaaagaaactgaaatttacttacagagtaaaataaattaaaaagagaaaacgagaagtggaggagtggaggagttctcgacacgaaatttcgattcagacggcaaaaaatgagattcttctataacacggcgaaaatctagggatcaaacaaagcaaccaggggttgaaatttcggagcaaagcgatctctcacacgttttaaagtaagaagaaataaaagaaatgtttttaaaaagaaagaaaaattctaaaaaggaaagagcaaagtttggccaacaaaaaatcgaagcttcggttcagacccgctggtctgcttttgtacacctgttccttaactatttataattctagtcctttttattctttgcagttcatggaactcaccactttctttcgttcctctggtcgtcgtctgatttctcgcatttatatttctcatttcctggaaaaaatggagtttattaattaatttctccttatagaccaattatatgggcctttaaaaggcctctattgtatggcaatgggtcaacaaactctacctataaacggatttgttaaatttaggcctttattacataccaatgatattttaccaatgaaatatttgtataattaaatttcatattatcataggataaaaaataaattatcacattaacgcatgttgaacaaaaattttacatggattatctttctttctatttttgcggagtaggttgtttaagtatgtttttgtcctttcaagaatttgtcagtttataacttataagtaaaattttaggtacagtatatatataagttgtaaaagttgataggtattcttgtaatcaaggtttactatcaaattttaaactaaaaatggttaatcattcatcaacacatgctaattatgtttagtatgggtagatgtgcctgtagatagagtgtcctaggagagtgtggtcacgcgcttacgctaaacaaataatatatcctctgtctttgctacacgtgtataaacagcagcaaagatgaaacgtgattaaataaaataagaggttgagaaagcgagtagaagatatttagataaacgcgggagtgcaattatggtttgtttgttggaattaagagacaaccttatccagagtaagctcgccacgtgtattaaaaacattattattgtctgttagtcacagtcgagtaactccagataatcttctctgtctcatttctcgtcgtctttttaaaaacgttttactttccacggcgaattttggtctgattccaaattcttccctagtttgaaaaatcttctgtattctgaaaagagattttatgcgtatcgctgaaataggaagaaaacagattcctttccatttcccaaattttgtcattgagtcttggcatttcaaccaatcgcaatttattgaaattccggcgagtcattagatttttttggattccgtttcaaggtacggtgctttttcgcagattgagaagagcttaataagaaag

SEQ ID NO: 4459 - DNA, 2000 bp, Arabidopsis thaliana
gttcaataaatccaagacagtgcaactaaaacttgctcctgtcattttagttttctcaactcaattcaaatgtaaagcctttttgtttcagtttctcgattccatttttggcaacttttcgggattgttatcaaaacgtcgattctttaattgaagggaaaactattgtctccaaatgttgttttcttacccacagacaacaaacagataaatgaggacgtttttggtcctatgaaaaatgaaaatatatttgttttgtgaaagtctaattttagaacaaaatgaagcataaaattggtttgcctcaaagttaggataacatcagaaacaagaagcaaaggcaaagagctctgcttattactacaactgtctttgtttgtcttctacttagctgtcggaatgtagtaaaaatctaaagcaagtggagaggtgaagacaaaactcaataaacccgtgttgtactcgccacgcaaagcatagttttgaaattcgtaaatcgtaatatcttcatacccaaacaaacacttttataataccaaatcgaataaagagaaaagcatctctatgactctctctatctaccttctccgtccgtatccaaaacgacatcattgttccaccacctaacttcaatttaatttgcttgatctattactactaatatcttcatctttttttttactatatttgttcataattttaagaaataataaacacatagatggaagtgtttacatgcttctaatttgtttggttggggattttggcatgaacatggcggacaaattgtagtgctaatagtaaatgcaaagaactcaagtaatcataacaaggttggttctttattcctttgtgaccttagtagtatttggtagccgatagacccagttgaaacctaacattagttaactcacacagtcacactaaacatggcgacgttatcttaaattaaatattacagaatattttccatcacatacacaaataaaaggagatgtattctccgtataaaaacatataagtagatttcatcgttacgtattcgaatcaaacgattatacactgcacgcggcaacactaacgaaatggatttaagtctaaagtgcaaatgaatatatttgtgataatgttattgagtggcgctagtcgcacactcaacactacaaaacgtcgacaataacgaaaacaaaacattattaagtggcaccacacacgagaatattcgtagtgagacacgcttcttactcgttattccaacaacaaaaatgttaaacataacaatgtactcttttttttttttgataaaagatcaacacaaaataaaaataccttttagattcactttttcccgatatttagataacaatctgttaaaatctagaaatctaaattatttgtggttaccaatccatttacttttaagaaatttactgatccaaaaacaagcgtgtggtgcacgtgagaaagtagggtttgatcaaaccaatcaaaaactcaaaaggcttctcatcgtttagtctcagccgtcgatctccttttatcgagcccatacaaactttcaagacaaaacatcatccagctgtttccatcgagttcacagctggcaaaaacctatcacaagtttccaaaagccaccattaaatttcactcttacggtacaccaacacacagataataaaattttaattaattaccgaaatcttcaattaatcccatcagttagaataggtaattacgttgggattgatcattcaaaacgactaaaaacccacataactattcacgcgctttgtgtgaaagcgcgtgtaaaccaaacttctctcttaagccaaataaaagagagacttgtccttcttctgcttcatcttcttgctttcttcacttctttaactctttgagttatttatttccagaagcttcatagtttctggaaaatgctaatccactagcggaataaaagacagatctttaatccactttagaaaccgcgttttctgaaa

SEQ ID NO: 4460 - DNA, 1915 bp, Arabidopsis thaliana
tgaagttggcgtgaaagatattgttgttgtctgaagaagtgtaatgagtactcaaaactgatgatgacgaatgtaagtaaatgtgatgcattcactcactttagtctcttagagctgttgttataaaagtctcctaatcaaagatctagtgtatttcaacatttcaaaaaacataatctatatataatctttatcttgttacactttagactgtaggaaactacaaaaagagccacaacaaatgactataagagaggaggcagaacaaggagaagatggacacaaagagacctcaagaaagtaagttgatggataagttgatagatggaaagtcaaatgattttgatgtgtaggtttttttttgttttgtttatcatgttcttataaaagttagagcaaaaaaaaaaatgaaagatgtgttttgttgtatatagaagttgtagtagaaaggataaggagacacaataaaacttaggtgatgttgatgctctcaatactttgcctttgtgtattgaccttgagggttatattaggaataagaagagtgattatgtaacccccaaacaaacttaatttagaaatagtagccattatcttaagcatgttatctcaaaacaaccatatagtaaaatgtttggacgaatcctgaatgattgcaacgtgcatgaaaacattggaaagcataaaaatcttggaaagaagggtccaaaaagatctgacggtggagaattcagacacaagcctacgtggacggaacagtcatttctggtcgagacagctcacgcgcggctggcggcgaaaacatgggacccaaacgtgaaaaccaatcatgtggaacggtctcgacacgtcagcaataacggacgaagtaatggggtccacacgcggcgggtatgtcgtggggcttatggttcgctgtaacggagaccctctcctctctctcttcttctctcccacgttctccaaacacttcttcctcaatcatttgctttctatttaccattatacccctttatcactcactcttttgaccacattattgaccctttttttgttgattgcaacataaatttagcaacctaaacattgggagtttagacttttaagtatcttgagtatctgtgattatagggtgggaaatctactgattagttgtcttataattttaattaatttgagttcattagtgagcgagagagtgataaaaaaaaggtcaaagacctaacaaaagaagagggggtgttccggtaatttggtaatggttattgtctacatcttctctcctttgacgttgaaaaagcccatcttttttcctttgctctcattcccacacagagaggtacaacaagactcgtcgctcttcgctttttcttctctctttctttctcttgccagtagtgtgatcttacgaagcttttagtagagaaaaagcatatacgctttgtctttcttaatcgactgataaggtactttttgtggaattttgcttttcttcattcactttgtcttagtttcgacttgtttggttgattctacttgtcttgtttcagatttagattttgactagtgggtttgctttagttgttgtctacaggaacaatggtttggttcaatctgttttcaaaatcagagctttcgaattttaaacattaaaacggttggtttgtttttatgaatatggtgataggtgatgactaggttgatgatcgtagcgttttgttgcaaataataaaagtgattgttgacattgctatgttacaatgtttagtccttaggatcagatggaacaaatgggtggctactcaaaacaacaaggtccatttttagtttgattaagggatttggatctgagcttacttcatcaactttgtcggaatatacatttgctttgtgtggatttggaagttgtccctga

SEQ ID NO: 4461 - DNA, 2000 bp, Arabidopsis thaliana
ctaaccttttataccaaacgtgaaacaaagcgaataagttttctttactagtctatgccaccctcacactatttacgtgtattaaaaatattgtagtatgactttttattattattattgtagtatgacttttaaaagcatttttactgtgtttttatattttcaaaatatcctttttactcaaaacatttgtcgatttatttctttgcattttatgatattttttttctttgttttaatttctgcatagtttcgcaattgagttttagaattttcaaagaggtttcagagtttgatcgatttggatatttaactagtatgacatgatcgattacattttaaaaataataatatcagcatatcatcatcaattatatagttgatgatgatatgctattattgttttttattagtgataataactgttgaaaaaaaccactgatcgtcagtcgaattcctgatcataaaagtcatggtccatatcagctatatgagcttacacggcattcctagctcttattataaatctccccacattataatgaaagcaaaaacttaaccaattgcaacatgcaaataaactaacctctatgaacggagttaagtaactattgatcgaggaaaactagcaagtcagagcaataactgttacttaccatttaattttaacttatgaaatgatgggaaacgtatagtaaaataaaataaccaaaacgtaagaagtaaacaaggtgcattttgaaacccaaaatgttaaaatactggcgatttaatctcttaaagcttaaatgattaagtaactacctattgataatactcacaatttaattttatttgaaaatatatatttttaggatttttaaccaacagcataaaggaagaaattcacattcctataatgtgatttttaggctaaaaaggaagatggaattctaatattatctttgtcaatttttcaatcattgatcaacttttgtatagataggaaaacaactatgtgtaatttttttaagctacttagagtttatgtgtttgagtttcttttgggagatgtaagaattttttagatatccgagtttttttttggtacaaggttaacttacaagatttaaagagtacaagatttacgagttgatcgagcgtcttcaatattttgagttgtgaattcaaatttataattcattgtttctgtttcggttaaaaatatggttttaagcacttgatttattatactcccttcgttattttataaatgatgttttaagcttaaatttttgttcttaaatagattattaaatttgattatttatattatgcagattatttttttattggttgattagaaaatagatgatgtttttgtttataaattataaaataataaattcttaatatgtgtgtaatcttctaaaacatcatttataaaagaatggaaggagtataagacttaatttattacgtatcggatcacaacaaacatgcacttgaatcacatccacctaacttccatctaggtgtttgtttttgcaattattcatatagaattgatttggtgatataagtttacgagttattaaaggaaaaaaaacaacaacaaaaaaaaacaaattcccaacattagttatccaagagtattttttttttttttagttatccaagagttaacaataccttctaatactgttctctacaagtctactatacctacgttgcaatgataatttcctgcgtgttttttttttccttttaaacgtcacatgtttaaacaattttcactaacccgttatttacacatgtaagagaaaaaaagatagccaaaaggacttatagtgttatctatttaaaaactaaacttgtggtgtctacctaattaacccatctttgtacgtaccaatatcgctttcttcaattattagtaatatataaatataaatgtttgtagtagctgccggtcattttttctttctctctctcctccctaagcaaaactaaaacaagct

SEQ ID NO: 4462 - DNA, 1070 bp, Arabidopsis thaliana
ttcgtacaggtcaagaaagtagagaagaaccataagtatctatctacctcagaagaagtttgaactgagttagccactgaatgattcttcctgagtgaatcaaggctcaaaggattgtcactggaggtggtggaattgagaacatcaaggacctgtttcaaacgctagtaagttacttgtaccaacaaaggatcggaagaacgtaagcagcaaaacaaagaacaccaaggacctcttttgtgaaaagagatggaattgattccagagcttcacgttctctccagttaagatcctgaataaacaaccattcaacaacacgtttcaaaatttctttcaaatctttcagtacaatgtgatgatcgtaagttgattaccttgttgatgaagttattcctgatgttgtatttctctgaaatgatttacagaaataagtacatcttccaagaactaaagaaaaagaatccattaatggttggtaaagaacgaaccaaacagtgaacgcttgtgaagtctgtagctgatcatgagggtggagtaaacgagaaataagagaaaccccaaaaccactgatgtcacacattgtcgatagaggtctctgcacctagatcttctttggattctcctcgccatcagaaacttcaaaccctaatcgaatctaagagacgatcgccaaattcagtagctctctctctctctctccaagacgctttttctttgctcttctctgatctgtatagctaaagtagctaacgaataacagactattatttcaaatcggttttatatatgcagcggaaaacattaacgtcgtcttttgggatccaattatttaaagaccctaacggcgtcgtttatcccgatggcttagagggtgatccaacgcatcgtttaaataattgccagttgtcaactaacgccgtcggattatgccttattgggcttgttaaacataaagcccagagctatttacgcaaaaatatctggcattaaatagttaaatcgagtttaccgaaagattcagatccttattcttctccaccggatctcgaaatcggagaattagccaaacg

SEQ ID NO: 4463 - DNA, 1932 bp, Arabidopsis thaliana
gtcttttgtttgtggctttttaccattcaagttttttttttcttttgggttttcagagagtgatgatgatattagagtgtgccttattatttagagatagtatctgataataccaacaaccatatgttttacttctctaacttcactccaaggacacagctttaaaatacttttaacacacaaaatcgtaatatcagatatcttttgcatattataaactaataacacccccttagttaagttccacacggatcattattttttgggtaaattctcgggactttattaatttaccttttgctaggagaaacagagcttttaaaacccaaaatagctaacaacatatatttttactgccccacataaaataggaaattaccatcctcccttgtttatatgaatcgattcccacattccacatttccatgttttgtaggaaccaatgatcacaatttcctattttaaagaccctacaaataaagcattgatcatttgtctacaaattaaagcaaattcatcttgaccagagctctactaattcattagacatggagatcattccattgatgctcatttccgttatcatactcttgacatcatttccggctccgattaaagtgtccggcaggggtggaggaggcggctttgttggtagtggcaactctcctagtattggaagcggctattttggtggtggtgggaatcctggcaccggctatatgggtgggggtatccctagcggcggcagcattagggatgggagtaatgttggcaccggttataggggtgggtttcaaggaggcaagccttcaggtggtggtgaccccggtgcggcaattgtggtgtttcctaagaagcccgaggaacctgtgaaggtggtgccaacgccaatgccacaagtttgcgaaccgaaagttagacattgcatcaatgtacatgtatacggacgcgccgggcaacctcaccgaggcggagcatgttgtaacaaatttaggtacgcgagaagatgtgtctgtaaattccttgtgtctaatgatactcacctaaacaaacaatctaatggtgtacttcgaggttgtcattttaaacgcaattgtgtcttccgtaactaagatctagagattatgtatgtaactaatagaaaataataactatgtatatacaagcaaatatatcttggaataattgtacatttttgtaaggttaaaaatgtatatcttaatgtattttgtaaatgatatatgagtgctcggatagacagttaaacttgttcttcggcgatgatcgtcgtttgcttgagaatacagtctgcgagcacatggtgagagacttggctatgctcccgatgggtactctttaatgctcttctacagaggtacaatcctacaccagagcttccaccgccgtacgtttctgctcctccgccggtgccttgttaatccaaatttttgcagtctaagagagttgtttggtcacattatcacacataaaataaacaaggatacagctttaatatatatatttttacatagaataaggtttgtatatctatattttggtcactatttgctagagaataagagattgctggatgatcttggcggtgctttctgatttctgtaacaacataactttacctatctatattgatatgcatggaaagtttataagaattaatcatgatatataatatatgttgcagtttatatagtacatgacatgtataacgaaacttttgtctcgtaatttctcttgcgtagaaaagtctgatcgggaaggactgaggggtattttcgtaattttacagattgcgattctaacccatatgaccatatcacgtaccacggagtctataaatattaatcacccatatacacataacataaagttgtaagaaaaaagagagagacagagatttactcaacggctaag

SEQ ID NO: 4464 - DNA, 2000 bp, Arabidopsis thaliana
attaggaaaacgactctccgacgaggcaactttactttcatttctactttgttagttaagcttttccactaaatcattaatgaaggaatcaatatgtaatcaactaatcaaataacaaacaatagtctctaggaactatgacgcagcggatattaaaatggagatttatattatattgttgttattgttataataatcacatatattgtctttcttactaaaactacgttctcaagagtgactcttcaacatttttttaaatgtgaacaatggttagtgttaattacacggacttgctttcgctttattggccgtccataaatctgcttttgaggaatgggtttttctttaattagttatcaattccttgctttgaggattctacttactaaatttaatattatatgatttctatttacaagatgtttttgtcaaaagaatgaaaattaaacaaattacacattatatacacatatatagatatgatgattctaatccaaacattatttctctatataattaatttcaacattttaaagattgatttgttcaatttcctgtaaaagtttatactaatgaaatgattagttttgttaattgtgattaggatgattacttatcttttattattaccttattttctagatgctctaatatagatcacacttattcgttcgattaacctactcaagagtataacactcatggatcatgtaaaaaataatttattcattgtaatttggtctagtattcatcacaataatttattcattttgtatttgattcaagataggtccatgcatatttacaacgaaaagaagaatggtaagaactccattggtttactcgtattctgtgtttgactttgatatatatatatatatatattcttaaaggcggctatttagaaatctcgaataatagcttttctctagtttctaatttctacgttctgttaaaagtttatattcatgattagaaactgatggcccattgggttgatattaatctacaaagaaggctcgtaaatttggcccattagtatattgtttaaaacgagtcaggagggactgagagtccacccaaattccagaacctgttttgaacatttattaagtcagtaattatattttggttatgagattagtggctaggttcgaagttagtaagttagtgatagtaatcattgtaggaaaagttgaatccaagctttttcaacaaaagattgtccccaccttgagacactagtacctagtgggtatatacgaattcgatgtacaataccattctttttcttcttctttctttttccattatatatttattttgattaatattgatcagactgcttactgcatatgcatgtgttgattagtcacctttattaaaagtatttgatttttgacttaggctcactaaccctagggattgctcttcttatttaatttttttgcatgttctcatttgaagagagcaaaaatcgacaaagaagagaatattttttgttaaaactctgaatctgattataatgaaaaattttaacgacaaaaaatggacgtagtttttacactatgcatcactttttcttgtaaaccctccattattttaaactttttaattatatcatttggtatagtaactttgttgggtttctttttcttatttaatataatacatcaaattttgggacaataaaaaatcaaataaagtaaaatagcaatttagaaggtgcagattcaagatcgatccaagaaatgcttttcacacactccttctcatgagataggacccattctataataataatatctactttaccttaacaaaacaattttaaaataaatgattcgttaccttcctctttaaaactcgtattagtagcaattagtcgcataatcacacgaccaactttcccttaaaatcaacagacagaaagtgagtgttatagacttatagtgagaaagagataaagatagaaagaaaagagagaaaaagagaga

SEQ ID NO: 4465 - DNA, 2000 bp, Arabidopsis thaliana
ttttgttttggatttgtctcaaccagttaagaagtgatcgtatttactagtggtatacgatgatgtttctttaaatctgaattgggtctacaaaatacataactaaacttcaaaccgggtttatactttatacaaacacgaaaatataaagatagagacaattcaccagagaagatgtgtatttatataaaaattatccatacagattttcggacctatctgtttgatatttaatatatataaatacgttaacatatttcaccagagaagatgtgtatttttcgaaataattagtttgtgtggtcctcctcccgatatagataaaagatcattagatatcgattaacaattttatctccaaaaaaggatatttttttggtgccactagctagacaagacgttcgataagctgaattattattggatttctaagttacgttttctttagtaatccgagggaccaaaaatagcaaatgcctctttagacacgtcgctacttaacgccattgccccattgtctctgtactagcctccaaatatttggattaatggtcacttaggtaatgaggaaattgtagtattttgtaatgtggttttgtccaacttataaaaacttacaattgcaagtaattaattattcacatggagatgtaagattatgtcatataactaaaaacacaatttaagaacaacaataagaaacaatggacaaacaagcatagaaaatatacaaatcaaatgaattttatctgttgggatggaaagatattataaaaattgattaaaaccaatatagttgtattactcacaggtaagaaaaaacgatattcttatttttcatatcaattacaagtgggggcatataggtacgagagagtgtttgtgtccacattaaaaacaaaaaaagatttttgttagaagaaatttaataaaaataatttgacaggcatttccatccaactagatatttatgggagggaaaaagatgtgtatgtaaaaatgtccatatgtatcaaaatatgctatttttggtctttcttaaggcttttttccaaaataagtaaaggatgaggtttcaagcgtccatcatatttgcgacacatatgactgactatttagctcctccctctttctttctcttattttattatctttctccaagaaataaaatagaaaagaaaatatatatggtttcacaaacaccattaccataactacaacgagaagaggatcttttttaaggagaaaagcagagagagaagagacgagtgtgtgaagtttttttgtcttttgtttcttttattacacacaaatagatgaaacgaggaaagctacttcttttgctacttccataaaaaggttcttcctttcgcagagaatcaactttgatcatcttcttccttctctttctttcttcttctccctccagtaatgcttatatagtctcctcctatatctctacctatacatacacaaaccctttatcctcgaaagcttcctcctggttaggtttttatcaaacccttttagccaatcggtaagatctcttcgtcatgatcttttcttttttcttttgctttgtactctgatggatctataaacttatatgggtttggtttcatttggttcgatttgatgtgtttggtttctttgtcctaaatctcatgaaaggaggttgcatccttcaattaaaccgataacaaaagtttccattacagacttatagatcagatactttagattgttttgctttttgggtacttaatctttcgttgacttcatcagtcttctcccacccaaacaaaaaagtcatatttcgatcatatcttcatttttttaacctactctctttgattcatatatgaaatgggttgttttatgtgtgtgactaatcttgttattgaggtggttgcaccattgatctaccgttttcttcaatttttgaaaaaataattttattttttttctgtgtgcaagggaaattaactaaagaagaagat

SEQ ID NO: 4466 - DNA, 986 bp, Arabidopsis thaliana
tgatatcgaacaattgcttcttgtggattgcttttgcgttttttggctcgcttttccccagaaaatgaagggaaagttggagagcaaaaaaaaaaaaaaaaaaaaaaggttagagaagagacatttttgctttaggcgttgctttcaccaaattttggaataatacggcaagcaggggaatattgaagggagcgttacggtatttaaaggttaatcatttaggtttcattttgcccctctaacgtttgctaaattacgattttactcttctctatttatggttttttgattttttttctctttttttttccttctttatcttataaataaaagattcatagctctgtttttgttttcattctttttaacaaatttttttcagaaacaaaattggtcaacttttcataattggtttgtgtgtattttttttggtaagaatattgaattgatgcatatatcaatttttttgtttttaatatataatatcttactcaacacataaaagaaaattaataaatactcagatatcttcttctttatttgattttccttaagaatttgaaagagcaggctttttacaaagcctcaaagaaaagcccatatggctttggtttgatgaattaagaattgcttttctctaattgtgtgcgcccgacccgctttgtatcaagccgacccgtttcgttttaaaaatgcattttgagccacagaaaaggggacccaccacgaaaaaaatagagattctcttctaaaatatcatcaaagtacaaagaatttaaagccgaaagaaaaattgtttaaaaagattcgcagaaaaaaaaaaaaaaagggtgaggcggtcacttcactgacgacgtgtgctatacatacacagtcaaatacaaccctttccccaaattgaccccaaaaccaaaaacaaatcagaagaaaattaaaataaacctaaaagagcaaatttttattcgcattgctctcaaaaatcatcc

SEQ ID NO: 4467 - DNA, 2000 bp, Arabidopsis thaliana
tgttcaaagagttaacaacggttatttttattttaaagtttaaacggctgtagatatttataatttaacttaagttggaagacataagaaaaaaaaagatgattgttccgaggttggttagaagatggtgaggcaagaggcataatgacaagaacaagacttgggaacaaggtgattgcatttggcagatactttacatttacacgaaaatctttgtataaacatccaaatattaaaatctaaactaattttcataatcactttttggttattgaaaaaggtattgactaggaattagattctagaacttggaacaagagaatgatatatgattgtataattgactaactcacttgatcaagttgcatatatagacatggatttgatggaagtatgtatacatatagaaattgtgtgagcagggttttgtaagtgagagatgagaaagcaattaaggttggggaagagaagagcattggatgatgcaccgacgcacgtgcatgtctctgagagagaaagaagaaaagttcctttacgaggcgatgagtgaaagtgagaagaaagagagagttccttacttccaaagccacctccctcccactttgcccatcattcatttcctctcactctctcttttttttctttctttttttgcatttataacctcactccaccaattatatttttagtataacctatgattatgaatctatgatcgatcggtcatttctgttgtcctaatttatcaaaaggatattgatccaaacagacgatcaagattttgaaaaatgagaatattagacgcttgatcaacaatttttgttcgtcaaagttttggtcattacaactaaacgatccaattcatcaaggggctattgcgcttagagaagaaagacgtagtaagaattagttaacttttttatattggaaatgcatcggagaaaatgtagtgttcgagacctaacaccaaagtctcaaaagttttgggtccgataagacgatcctaaattaaattccatgatgacagctaaactatacaaccacaattagccaatatatacgttattatatatgtctatcttctaccattttactttttgttgtaccttacttttgttttatctgaattttgatatttttcggcattatgagtgattagacatctatagatattcttttgactttccaattcaatgattacactatactgaccgcacaacaaatccaataacgcacaacaaatccaatactataattgtagatagaccaacatcaactatagtattggatttcattaactattaatgattcgggtttccagtttacaatattgggcttataatgatcggaatgtttttgttaaatttgggcctataatgggctttactttaaagacaattaaacacaattctgacgcgttgacaaaaacaaatcagatacaacctttttttttttgaccgcaaagaaaaaaacaattatacaaattacaaagcagtcacgatggaccgtttataaatacgaacgtgccttgcataatctcttacttacgagaagattaatatccaatggagccctccttaatcatatgattaaattatccattgttttgtgctataaattcttccaaaagatgctataaaaaccccaaattgaccataaaaaaattatgcgtatcaatcagtatccacgtggcaatatctgaggagatacagagagagacaaaaaccctaagacgctttttagtttcgtcctccgtcaatctctctcgccgctttatccttgttacaaatcccatcgatcttttcggaatcttccctcattatgctcagccaccattaccagagctccattgtttcagttctccgttcaacgattatcggaattattcacaacactattagtatcaccgtcgccaaccgattttgattaccagctttggtgacgacagtcgtgattaaggaggttttggtaaatttcttcgttcctgtttgttttcaaag

SEQ ID NO: 4468 - DNA, 2000 bp, Arabidopsis thaliana
ttaagaagaaagcaaaagataccttggaaaatattatggttattacactttgagaagaaaagaatagacaactaagtatctaaatttttaactaaaaagatagaggaaaactaagtagctaaaagtgcattgcttttccgtatatgcaatgcaaagatttagatgcaatcataaagttcattaaaaaatttagaccaaactccttgtccttactagctagttcctgaaaccaaggccggcccaatgcctgaaacttgtaaaatttttaatcgattaattagctattagctatgtggattatcaattaagttgatatatttgcatgtaattttcttctctaaaaatcgattaatttattttgagcggatttgaggtttcttgctggagggacatactcctgcaaagtgtccatatgttaagagttttgctaacatgtgatgtgaaggagtgcttgagaagtatttgatattataaaaaagaaaagttttagaattttgtgtaagatttcgaattaacatatgtcctaataccctgttagaaattttgaaaaaggccctaagtccaaaattagatttgcttcgagctagatagaattgaggtacttctttatttgattttcttgtcaagtacttcatcccaactcccaagtagcccatatgtccaaaactaattaactataaatgcataatttatatgagggtttgtaaaaatattctattttcttagggtttgtataggcatctaatttaacaactacaagttagactttagctcttagataatagcctagttttacaagcaaggataaaatactcatcttagaaacaactcttaatcattgtagtttagcttagttacttttaaacaaaacaacccaaatgtatgggcttgactaatggcccagtaatggccttcttgactaactccattttgactttcttcttcctcttcccatcatttcttcttctttttcatcttgatttatgatctctgcttttcatcttcttcttctcacttaatcaaaagactcaattgagtcaattctcaattctcaacagtaacattctttttttgctacaaaattcttcaataataacttcaaaattatgttatcttagagcttaagtatatattataaggatactttttgtttcttacattgaatttattgtatctatgatgttctaattatttcttgtgctttgaagactaacatcttgatatatcattttcagaattacttttagaaaattcggaagtatatagtagtttttttttggtaaaccggaagacgaaagtatatagttgaaccataattcagtactaatttgtcctcaacttttttttttttggtgtgttcctcaatcttatttaatagtagcactaatttcacaaaaaaacgacaaaatgaaatatagatcaacaataattaatatggacccattaatatatacagttttcaagactaggatgagacaataaaattgtaaactctactaattttagcaatatctattgtcaaaaattaaacaatctgctatccatactttcaatacgcatacacaaacaatttattgtttcgaagcaaacacatatacagcacaaaactttatattagtattgtctttgtatgactattaaaactcgatgttatagtggtaagtattaaaatgtatataataaaagaaaaaaccaaaacatatataattatctttcatctaaatagtaaaccaaatatataaatatatagtataatgttttgtaagtttttaaattcctattattttgcacgataagactcaattatttaagaagagaatatactactaacgtaaaatctataatggcccaacaaaattaaatattctaaaaagtcacatttattgttgaccttcacaaaaaaaaaaaactctcaattttctgtttcttataacaacataacaaacaaaaaaaggcccaaagagtattttcctccgaattcgccgacgactaatcacgag

SEQ ID NO: 4469 - DNA, 875 bp, Arabidopsis thaliana
ctcctttgtttttagtttttacggtcaaactcaacgatttcgaagataaagcaaatcaatcacaacgagagaaacagacgaagctgattcgaagagtatttatttaattccctttccgctatgaaaattcccagggaaattacgcggaagacgatggagattcaaggaaagttccaaatctctgacgattacgcgtgtgtacttaatttgagattaatcgcaattttgatttcaacgattctttgattctttctttcctctagaagatagagactccacacttaatgggccttttgtttataaacttaaatacttaatacagatattgggctcaaaaggcctaataattgtcttagacctgttcgttctagctttcgtctaaattgcaaggttcgtttttaaaagtgaagtttgagtttgacggtaacaaacaagcgatggactacaaaagaagaacgtgttggactacaaaagaagaacgtgttgtttaggcctctttgccgacatagcagagagtccatgtcacaatcaccttatttattatcttcttcattactgtaattacaagaagattcagcaaaatgtaatcattgaatgacacagagacttttctaaaatcttgtatttatcaagaacattctaaaaccattatgtgttcttatcttattggttaaggattaaactaaatgtcaaaattcagcctaaaatagtccaactcttaatcccaaaggtaacatcatcaaaaccgcgttttatatatgtataatccaatcttataaattaaaaaaccaagttcaacacaatccatcacatccatttcaatagaagacgaagaacgtttcagaatcatcaaccaaattcagaaaatttcagcc

SEQ ID NO: 4470 - DNA, 1446 bp, Arabidopsis thaliana
aattaaagtgtacatagttcgggttggaggagtggaggaaaaaaaagagggggtcgaaatatgtaatttttttcaagtatgggtagtgaaagattgaatattggcttattgtttttgatttgtcatattgttggttgaaatctagtaatttattgccctcataggaaaaagaagtgtgtatgcaataatgaaagtatgagacaaatttttctttgctttataagttgcattaatcttcaaatctaaaatcagaaatctttgatcccactgacaacgtgaaaacatttttactgtattggttggctaaatgagttttagttattacaccaagagatttgagttcaaacttcaaaatatactatttttgtttgagtttgttgttcaagtattacatagctgattacagaaaccaaagaaatataagatccaatgtacttggacttcttttctttttttgtcgtcaatttcattaaatccttaaaaggattacatggtgaaaggaaaacccacatatacacaaagttaaagcccaattaacccaaatattgattacgatgaaagaacaaaatgggctaaaaagagacacgtgtgtacacgtggaggcatggatgaaatataagatccaatgtacttggacttctaaaataacaaataatgtaacactagattttagaaaacaaaaaccatccaactcgatcattcatcaatattatatagagaaaacagtcataatgttagagagagacgtatgaatcgaaattcatattactgtatttcgattacctaaaaagtttcgaaaaagaattaaaagtttgtgtggaagattccaatacacgttgctatcggaagaagacttggaaaattattcctcaagtcgttaatgcttggaattagtgactaacaatcatcattattccattgaaagagccgcccacgacgcgtttccattttccacaccagtcaaagttgatgtctcaaattagtaactgatttacaattttaaattacaaaatacaaagcccgtacaagctaatgtaaacggaagtaaaaccaaatacattaacaacttttagtttagctgttcaaaggacagagatatgacctcaaccttaacccaatctttcgtctgtgtttgaaacttctgctcgtaaagagactctagtaaaacccttcggaagaaattttttaggtagtcgccatcatataatttaaagcttatgagacttgttatgttacaagcagagaccaaagactattcataatcacttatcagagtataaaatactctttttttgtcaatcgagtataaaatactctgatatcacttatacaaagttctacgaaactcattaaagatttgagagtgtacaagggacaaaaggtgctataaatatctcttaaaagagagctaaaagttaaggaaacacttaaccaagcaaacaacaa

SEQ ID NO: 4471 - DNA, 1264 bp, Arabidopsis thaliana
tattcttctatgaaacaaaagagagagacatttacaaaaagaaaaagcagaggtttgagatatctaggcaataatggaaattattgaaaactaataagcacgacgttatttttgtaggtcaacttatgaaaaaaaatatgtatacaagagtcggttgtctcgaacctaaataaaactaaactaatatgtttgatttgattaacattctataaagatttaaaaattaacgatccaataatcttccaatgccgtttagttgatgtcaatgtcctgttttttaacgttgtattcgtacgtatgcataatgcactaatatatcttattttcgactaaataaatcaaattgaagtaaataatataacttggtttttgctttttgtattcaattcagttttggttaggcgcgtttgttaggtttttgatttttttttcttttcttttagtttatatacatagaatccatattgaacaatatcttggtttggtttggttcgacacactttagttttaatttgaattccaatttccagaaactgccatccatattccatggtaagaaacaaaaaaaaaaaaaatccaattcaatggcaaatgaatagccaaataggtaagctacaacgtggaagactaattttacattgtttaaaaagaagcaaagattgtgaggatcaaaatggttccaaaggcccaacaatcacaacaaactttgataaaaaaaagaagtaaacgtagcaattggcttcgctagctggaagctggtccagggaggatacgtgcatggaacacacaacaaaaccttcttatgatttaaatggtcgttgacttttgacccttgtggttttttggacaaaaccctgtgtttttatttcatttctataaaaaagatttatctgcctttgttatgttttcttcttattaattaagttatcatcggacaaagttcaattactagttattaaaaaaaaaggttctatagttattataagtttgtaacaaaaaaaaaaatgttgtcagaatcagttgataacacatttgtctaattccttcaattttgggccaatgaaattcgaaagcccaaattacataatgggccgaaccatattattctctctctcgctctctttctttctctgtgctcttctccttcacggcgaagtgactcacttccatggattcctctctgctctcggcggctacggccgataccttcaacggcaatgcggcggatcaaattcctcctccgttacagcctccgggaacggat

SEQ ID NO: 4472 - DNA, 2000 bp, Arabidopsis thaliana
ttaatgaaaaagttgagacacaaccactaaactttacggcattaataacggatctcatttatgaacctgcgtacaaatttggtctgaagttaagtggtactatcccggaaataacttaaatcttatcctaaactatattctttccattttatagtacgagatgttttggaaaaaaaaacaaatagtttcataataaagtaatattttcaagttcttatgcaatattttatgattagttattagttatattatgcattttctttatgtttggttgaactttttaaaaatatgtaatttttaatatacgtgtttttagttaaacatcttatattttaaaacggattaagtatctttttagtcataatttatctttatacacaaaaaagtaatactttgtcgattcttaacccatgcaattgtttatgtgttctgaaattgattgatatgatcctagctcaactggcgttaatagacttcgtatgaagggaaaaaatttcaaaatcattaatttaaaagttcgacgtgaaaaaatgtaataatttaacattctcttataatgcttccgtaagataaatttatggactattatccgactttttgataatgggtatgcaaaaacttgtcatatctaaaaaaaatatcaccaatgttaatttatacttgggcataaatgtatcattaaaaaaaccttggtggcttggtgcatatagaagagagtgaggctgtgagggagcactatagaccaactagacatctctaagcgaggagaacccatccgcatcgcatgtatgcattgagatagctagggcctaggggccattgagtcgatcgaccacatacacctctttaaataatcttctaatattaaagttttaaatcaatgccccgcccaactctaccttttccacgaaaacggaataaagtgtttccgggtgaaagaaaatacttttcaacgatagattgtgttgctatttttatagaatatgttaaatttaagtataatataagataggttcctataaaaaaattgggtagaaaagtttagctttgatactccatatagtttatatattagtgcagcgaggtgatacgtttactagtctaacttaacaaaaaaaaaagagttaattagtttatatattgattctttcaacgtaatcaatctgatttagataatccgtcccaactcccaattatatctgtcattcaagtatttgattacaagggcaattcatttcggactagttgattgtaaatttcgtgtctcgttatctatttgaaatagtaggtctatttagggggtatacatctggattgatagctgataaggactatatacatgtctttttgaatttttgatatataaactactattcaaaattatcttcatagaaaaacggatcatatcatttggatatcaaatttaactcgagatttcaaataaataattcactattccaactgatcttactacatcagtaaaaaaaaattggtagtacaatctcgaggaacaaaaaagtttacaaatgaaatttagaatcttgtttaatctttaaatggatagtttttcataactcttttaattagtctagtttttgatacaaattttatccggttatagaaaacattaaaggaccctaagtttggatttcagcaaaattatatatattccattctcacttagggatgaaatgacatcattcatcactacgtcatttgagcttacgtcaagctcaccataagcaaaagaaatgggtggataagttcaagttccatctcatttcctcacacatctctctttcttccttctcatttcctcgcatcttcctctaaaaaaaaaaatcaaagaaaccaacaaaataaaaagtgcccatcattacaaatcttatttccaccttatatttacacacacttctcttctttcctttaatcatacaaaccacaccaagaggaaagaaaaataagataccactcaccaaaaacttcctcaaaactaacaa

SEQ ID NO: 4473 - DNA, 2000 bp, Arabidopsis thaliana
aattcgaatatcaaatataaattacttataggttcgactgtaaaatgagatatgaaagaaagaaataatatatgatgatgtaatgcatgagaaagtccaaaatgatcggcatatgggattaagcgattccatatagttaagtcaagttactatttcagataaatggataagtttgtcgtctatatgttctgttatctccaaacccaaatctataacattgcgacatttttgaatcgttaacggcaaaataagtggggaggggggggggaaggaaaaaaggaaggacactgagattttgataaagttcggtagccaaatttgtgcatgacttttaagaaaatacgtatgctgatccaaaaacaaacaactaaatagattttagtttgagaaaatcgaagtaacaaaattattatttaatatatagtgtgagaatttaacagctactaataattatcataacacgaattaagtgtaatagtaatatatgtaggaaaatggtttagcaccactcacttgattaactcgacttaaaccaaatataaagtaatatttatagatgtagttggttgtatttttgcaagctttggtactcgatatctaaatttttaatggaaaaattagtcgagtggtaattcgttatatataagaaaatattttgtttgtaattgtgcaaactttagcattggacatctaactatattctgaaaaatcagcggaatgataaaagttcggattttccttctttttatttaagtaaacataattggtgttctgaaaaccaaaagaaggaagaaggcaattaagatttgttaaagttcgtcacgatattgatgtcaagaaaaaaggaaaaaaaaaaaaaatcgtcacgatggtatcgtcaatttgtctagtggattttgaaaagccgtgtgggcttgactttgaccgaacaaggcacacgtatacatctagtactactgaagaaatctctcattagaacgcaaaccacgttccgcacactcttaatatactattagtctattactatcaccaactagttgtcattttttttgtcaaacgtgctaattaattcacaaatagaagtattaaacttcctaattaagcacgcctttactacatttcattattattatacatgtaatcaaccatttcttttatcccacatgtcatttgtagtcctgattttatgactttatgcatcaagttatctttttttttgtcactccatgcatcaagttatctaaacaacataattattgtctgaaaaatctaagatgatatacaacatatgtatttaattacacattaggcttgtttaacaattcttgattatttttactctttttgggtgagttcttgatggatgtcttgaattacaaaactacatattctgaaaatattaaccttgagtttaggccggctatgctataacgaaaaataaataaaagcaactaacccgacagaaatgtcaaccaactatccaaaatgaaaaacaaacgtggagagcgtcatattattagtaggccaatcacacaccaaatgtttgtttaacaaaaaaaataagaatgtcaaccaactatccaaaattaaaatcaagaatacatttcatatgtttccaatatgtttttcttaaacaaaattgggactaaagattggaccaaatacgtgtgcgggtggacccgatagaagccgagttgagtctaaagactaaaaagtaaacaaaaaatgataagaccatcacttagtttattgcatgaaaatgaaaagcacatgctcctctctctctcttctgcctctttccatctagtttcctcttaaaactccattatatatagaaacaaaatcttttctctcttcaacaatcccaccattaaaaaagaagaacccaagatcgactcttacttcgaatctctctcaactttcttcctcagcttacgggaacttccacacatatacatccacaagaacccatatcgaagattcatcctacatatatttac

SEQ ID NO: 4474 - DNA, 2000 bp, Arabidopsis thaliana
gaaactgctatatgcaagtagtcttatttaagaaattgtgctatgaaatagaaattgttgtatggatagtaatagtcttcgcaacaaatttagttttcattgtttgacactttaacatgaaaggttagcataaaaaaaaataaagtggaaacttgaaatcaactaaattttcatgttcctttttaaagtataaaacttaaacataatataaatagtaccatatgatttaaacttaaactgtcttttttacttttttttctttcacagatttaatcttcatctcacatctcaaaagataaatttttattctgcagtaaaaaattcattagcaaactctctttaattaaatatcaaaatatgttttttaatgtaaaaatattaattaatatcttaaactttgtctttttagtgaaatatcttatatattataacagaagaagtatatatatatatatatatataaaaaaaataaagatgtatattggttacccaaaattagaagttcacaagaaaatcaatattcaatatttactcaatgaaattttcaacaaaaaaaagtcttaaataaagaaagatttacccactgaatctgctgaacccgtggctccgtcggttttgattagtcaccgccattctttccgaagaaaaacaataataacagtaatactaatatataggtggctgtaatgttgcatcttgatcaaaaagagaaataattttgtagttattttaaggaaaaagatgaacgtgatcattttccatcattcagtttttttttttttttcattttccaacattcatacataggtattttaaacttttagatgattcaaggaactattttaggttataataatgtatacaaaaaattagattactcaataattaatatctcatcaatattgctgaaaatcacatctgttaattttatcaaaaaaaaatattactaaaaaacagtttaataagaaaatattactgaaaataacgtttaataagaaaataaatattgtatgattattagattttttctgataatatgtttaattgatttatcaaatctcaagaataaaaggaacgttgttcctatgtttaactgaaggatataagaacattgataaacttctaaactagaaccaggggtaaaaggattatcaaatctcaataataaaaggaacgttcttcctatgttaacacattgataattctttaatttactggtaaaaaatatacggtttacaaaatatatatatatatatatatatatatatatatatatatatatatatatacggttttaatagttaccgatcacaaaaactattaaaattaatagtatgaaaatattatcaccacgatttttgtattactaattttattgctcttaattattttgtcatcttttatcgttatttttccattaaaaataaatacggctttgtgtcacgaataagaaaacatattttttagtaaaacaaattcgactaaaataaaaaggaaaatgttttgatcacatttttatattgtattacaggaaataaccaatgatagataataatatattattcaattgtcatcatttcttagttgacaaaaaaaaatctatacatgtttccgagacgttaaaagtatttacaaaactactccaacaattcacatttgttttataacaaatagggacaaaaatgatcattttaagcttattgaataactatgatcgtttatttttgtcaaacaaatggatggtttatttaattaagtcaagtcataagaaaaaattaatagtaagtgtgtaagaaaaaaattaaaaagtcacaaatggtcccatacgtgtgattcggcacgatacttcctaaaagcataccactaggctctctcctatataacttcatctccaccaacgatgcattttcgtcctcagatctcatctcactcacaagagagagatagagagagaaaaaggctctgctttctacattatttacgattatacactttccaac

SEQ ID NO: 4475 - DNA, 2000 bp, Arabidopsis thaliana
ctacactatactttgcgcaaatcaaatctatcgaaaacgattttggtaatcccattcccatgagtgagttttgacccaaaacaaatttaaaaaagtaaccatttcattagtaaaacggtaaatatggttcataaaccttttagtggttattggtcctgtacactacactcgtgtgtgtcaacttcagctatgagatttttgctgtaactttttggataacggttcaattattacaaaggttatttcttacgtatgagaggtccaaattacaattgaataatatttgatgacatacaaagttaaaaaggattaatcataagaaatgaatgttggaatggaatgcatctatcgatctgactactttagatagcttgatgttggacttagtcagcaaagaccttatcatactcttgttgtattgtatatatcgtatcacacagtgactggttttttctacttttctctttggaacatatcaatcattatgtataaataaattttgtccaaattaatggccatttgtctcaaccataaataaatatttattcacacacctatatgactatttgagataattccatggtgacttggtcagcaaaaaccttgtcatactcttggtgtattatcacataactttgtagattatattcttatggaacatatcatatatatttgtccaaattaaacccatttgtattattttcccctctcgagtttaatatttcttatttagaaacagttaacaacttgacatagctcacataatcactcacagactatatatgtataagcaactaccattttaaatattatttagttatattgttagactgcaactattatttattttctttgccaaacaaatttatattttttcatgttaatacaatattatatcttgaacaaatgtatgcttaaatatattgacacaaaacaaaaacatataggggtttttaggaagaaattttgtacagattaattaatcctcatcagatttttattttatatcttatttttagaagtgtatgattttaaaactagaacaatcaaatcttagtaaatttcattcaacataatttttatgttattgctaatctattgaatgttaataagaattgtattataccaaattaccaatatgtgttttgatacttgtacttaaaacagaatgtggaatatcctttcccttattaatgatattaaacatcattacaattcatagttatagcaatgaaatattatccatagaaaggttgttgcataatgcatactagtaaagcatcaaccaacatattttgaaaatattcttaatcaaataaaaaacatatattggaaattctttaacagtagaaaaaaacatataataatagagaatcttaatcacatgtacaaagtcgtagttttgaaagtgtacattgaaagagacagttgtataaccctttgttgtctaattatataattaacccactatagttaaataaatgataaacttggttacaactacattaacaaaattgaaatgttgaattggtcagcctttgaccttatactctttcactaccaccaccccacttatcaattacactctggccctatacttccttataccaaagacttttcttcaatttgaaagttttgtctctcttttaaaaagaaataaaataattatttatggtttggtcatttggtcaaattttcaaacactgaaaatccaatgcctttatataccaaaccaacactcatccatttttatcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaa

SEQ ID NO: 4476 - DNA, 1373 bp, Arabidopsis thaliana
accacagatttgaggattcaatgacattcgtttttttgatgcattcatttgaaggttggtgtactcttgagttgcagaacgataagcttgtagaagcaattttttgtcattccatcatatattaattgattggagaagtctgtgtatgatcaatcgattctgctggatacaaattttatttttgtaagaagaaccattattgctcttaatccctatggcgatataaagttgcatgctacactatttcagtttggtttgactcaactgtcggatatgttactacatctatagttagaccatatgttcattttgcatgtatagtttttttcatagaaatattgtaaaactttgaagtcaaactttaacctagatcatgtgatattttaaaaaactttgtgaatgtaatacactcgaatagctattcaggtgacaaaacctaaacagagattgtcttaaacaattcagagaggatatagcatggtcgtctattttctttagttctcaggctgtattattacccggacgtgatctgattctagctgctacagtgtactatctccaacctggaggctacatccctgcagaagaaggtggtggactcagtgaatctgcaattatactttcaatgcaatcattacagctttgaagaactaagagagatatcattgtccttgcttttcttttgctatagcctaagtggttattgcctattggtcatgttggtgggtattgtactattgggtattgtactattgttcactcaagtatatgtatatgaccataaaaaaaaaaaaatggttattgcctattggtcagttttttcttttaagtttgacccaaatctttccataaattgtgataaaacttaattcataaaatatataaaatatattttatatgtcttttaaatagaagtattattagttaatcatgcagtgtatcattcatccagtgtattatatgttttttaaataaaagtattattaaaaaaaatgtcattttacgagacatggttatatggtaggacgggtttcgatcgatattaatacacaacgatatactagagataaaattgttgaattaacaatcgaaatacaattatacgatcttaaatactaaacaaaaaattaaaatttaaaaattagtttaaaaaatcgaccggtatatccaaattcaaacataagttttaccttaatgggccaacatatgggccttaaaaggctttggatctgttactattacactccacttgcaaaaacctatcttcttcttcttcttcgctgaacaacaaacaacgcttcacaaaaccttccgataaacctcacaaccctcttcctcctcacactacagtaagaaaaacacgcgcgaaagct

SEQ ID NO: 4477 - DNA, 1030 bp, Arabidopsis thaliana
tctgaaattatatactgtgttgaattctgctacaaaacaagctcctataatgaataacaatgaatttactcttttcaaaacaaaatagtgtcagctgactgatccaccttacatgaggtgtggtcgctcgtaggagccactgataggatatgtccatgttttctgaccatgtgtgttcattttgaatgactctccaacagttctctttcactcacagacaatacatttattgttgatggatttccaaagttccctaccaaatcttcccagattttactatcaataaatgtttgtttttggtctggagactctatcattattaaatagaacgtggagcacattgtttccagataagtagatttcaataggaagaagaggagctatggccatgctcgtgaagaaacctgtgaagtacttcatggtaattgtatattcttcttcgtcttctttggtttttgtttctcgcaatgtactagtataacttccttcctttctactttgctctgagtacttcttttagaaatgttattatccttgtaagcttcccaaagtgttacctgtccttttttggagattttaagaatacctaccaaatcttcccatgtactatcaatcagttattattgtttgagtgttcctttttgactaaccaatttttgtttgatttttaacgactagtaagctatgcaacacaattcatcacatgcttagcataagaataatggaataaacataccatatttgttttgtcaataagtgcgtttttgctttatgagtgcttgcttccacttgattagatctgtcctttgctgaatataaaattttgcaaagctgcagatttcataatgatttgagtacaattcaactgttagcatataaacaaaacaaaaaagattaaaagccgagatttgtttcaataagattttgccctacaaagattgtctgtttctcttaaaagatgaagtggcattgtaaattaaaagcctccaaaatggtataaaagtttagctttggtctaacgaaaacatca

SEQ ID NO: 4478 - DNA, 2000 bp, Arabidopsis thaliana
tttacactttcttaattatcaagatatcgtaacaagaaaatgatcaacccttcactatatggtttactttagttcatctatatattgcctgactttttagctaactaatgaaaactaagttaaattaaaaaaaaaaaaaaaattgttgcttaaagttaaatataattataatttttttgaggccagaatttatatataaaatatatatttgtctttgcaacttagcaagaaaacatcgtcctaggggaaaaactcatgaagaactttttatttggttaactcacaaggaatattttgctcttcatggattgtaattatacaacaaatgaagtaatgttagatgttcaagaaacactacattttacacctataagaaactatattattgtaatcgtgaagtctagtatttattaaaaaaaaaaaaagctagtatctatcactttaaaaaaaacatagaagcttttctttctctgtgtgtatagtagtaaaacaaaagaagatacagactggagtcatgtttccttaagcctatgagtaatagacttttatgtagtttaacaaaaaaaaatggtaacatgtatttggaaaaagtctattcttttactttgcaacacgtagtctaaagagcgagcttaagccaaaaacaatgggaagaaaactagcaaaaaaaaagagcaaaataacaaaaattagatgatcaataaaatattggaattacatgtacgcgtaaacgtcgtatattttccttcgtgccatttcaccttcccattatctcattgacttttcttatcccatatacggtaggagcaaaaccatgtatgactagaattatacgcgttaaacaattctagaatttcttacctaaaactaataaattccgtatttactcttctaattacgttaactctttacttaaatgacaatttaatgggttttttttttattatcttcctttacataaataagctttgttgaaaacataaaaatattgatgtaactttaatttaaaccattgatttataaaaacaaaaacaactttttatacagctaagcaaggtttgtgaataaatcatctttggtaaagtctcaatgagatatggaacccacatgagggaggtgagattacgattttttttaaaatattttagagagagagagaaggaaagagacttccacatgaagacagggtaaggaatggtaaaatacagctagcaaaagaagtgtttctcacacctaactctttataataataagagagaagcatcacccccattgctctccattactcattttttttcccaatcaatcactcttcacttctccccactccttactccttttttttttgcctttctaagcaatctctctcttcttcttatattctcatatttgattccttttctctctcatacgatctgcacaccactactaagaacaacagaggtttgatttcctcctcctccttcttcatttttggttttctttggaaattcttgaaattgtaatgtttttttttggaatcttgatgagtttttgcataaatcaagaagtgtcggtggaggcatttatttcacaccaattgttctgaattcagttttgttttaacactctttttttttttgtaactgaaaaatttgtgttttcttcttggttttcacacaagaattctagaagattgatagataaaatcaagaatgcttaattaacggtgacttttgacttttataaccttatagtctactgtgatttgaatttgtacatagaatggtcctctttatttacttatcaaaaaaaaaaaaaaaaatcaaaaaaggtgggccaaagaatgtttatttttcaaaattttgatttttaaggtggttccaaaatttggttcaaaattttcaaaacttattcagaaacttcctctgttcaaactcttgtcattttcctctataatatcattaaccccatctctcattatttattccagctagagagacttgcaataattgtaaaac

SEQ ID NO: 4479 - DNA, 968 bp, Arabidopsis thaliana
ttaatgaacctttctatctttattttatcaaaataaaattatacttcaaaaactgtataatgcatgttacgctatacttataaagaagtcttttattgtttcgtgtcgtactatcgttggaaatttggttgtcacatcaatcgttcaaaaccggcctctaaatgttggtctagtggcttacggaaataaatatcgaagtatttattgtttatgttctaaactaatataccgtgaatattcaacatttttataaaaaagattatcatatcgaaattcgatatacttgaccatccaataatggcttgtattgcttttttttgaataatcaaatccttctgtcgtattcttaagaccatactagtattatcttatttttgataaaagataagatacgatattggagccaaaaagtagagttaagatatgatattttcttgattactaaataacagaagggagaaactattgttagtttgagcttaagtaagaaaatatatggttattatggtttaattttgcatgattactactaataactaaatattctgtttatctgatctcattatacatgtagatactatttgttgcttttacaacaattgtagcaatgaaagaaaattagaaattgaagaaaatcttgaaatgaatagacaaaggaataaagaaagtgtaagaaagcaataaaataaacatgaatatagaaaatgcaattggcgaagagtacacgttgttccacttttctggagaaaaaagtgaataattgaagaaaagacgttataccttccccatccacattttcttgcttaactgcagaacaacaccaaattcgaccctatcaagttttgattcgtgtctacatagaaagagtctcaattgttctgtccctggacttttttttgtttcgtttttcttgttaagatcgaaaactctgttttggtagatttttgtgttcttgattttgattcaag

SEQ ID NO: 4480 - DNA, 282 bp, Arabidopsis thaliana
tttcaccggatttgattaccactaacacaatgtccatcacagagaacacaacttgattctatttcgtagtcaacgacatcgtttcggtcatcagagtgtatttgacgacgtcgtttccataatattgggctttaaagtcttatgggcccatgttcacaaattctaaaatacaaaactttagagataacagccgacgtggcaaaacatgaaagaccgagtagacattatagttttgagctcctcccatttcatatccttaagaaaaacaaaaacaaaaatcaa

SEQ ID NO: 4481 - DNA, 1607 bp, Arabidopsis thaliana
tgcttggaacgaagtgagggaaccggaattggaacatgacctagttgctaaactcgacgaccgtgctggtctcgtcggtttcgccgccgaaccggaagttgtaggtgtgctcatttctaaatctccgacgagagattagattaatcggagaagaagatagacgagttggagaagaaagacgagatctgacactcgaaagtgtaacagttaagactggaatcagaaatgtgtcgctcaattttattagtatttcactttttcaattttttcaaattttaatattgcataattttcagtatctggattttgcatttgtcgcggaaaatcgggtgtgaaagacaaagtatgaaaatatagtttaaattcgtgatacttcgtttaaattaataatcaataatacgagttctagtgtaatatataaacatccatgcaaataagttcggacattatcaaatttagagacatcacgttctacattatggattgttaatttttatttcaaaatttaagttaaaaaaaataaaaataaagaatctaattattcaaaatgtcaaattggtttcttgtacaaaaacatggcttgatatatggattaaggaattttttacatggtactataagtcaataatgaatggttcaaggaattttacatggtacactaacgaatgctttaaggaattgtgattgctattagttgtttaggttgtcgttaagattgttacgttacgtacactttgttggagttagagtcgagcaatgcacattggagaggcttccgagtgagtccgcatgcatataccattcattttttagcttcaacgactcaaaggccttcgtctggtgtttaatgcacgtgtgtaaatcataaatggatcagaggctggtggttcatcggaccaacaaggtctgcctaaatgacaagttaagacggtaaaatcgataagagacaaaccttaccgatttgatatttattttttttggttcgaatatgtaatcgattagtgtcattttgactatttgcatgttggtcattaaaagatcaaccacattttattattttaagtacaaaataaaaaatacaagaaacttaataaagttttggaaaacgtttaaaaatcatgaaattaaactaaaactatatagttagttcatttgtattaatttaaccataagtacatgtctttgtaatccttttatttatcaactccaccaaaaacaaaacgagtagtagtacgtcgttcattagcactattagaagcctttgaatcatattagcaaaaactgctatacgtcattttgtccaaagaggacgtttaccaaaagaaaatagataacactaaaattaggcatgtgataaacactccaacccccaaaatgtacaccgccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaa

SEQ ID NO: 4482 - DNA, 1642 bp, Arabidopsis thaliana
attcaacttagcaggctatataactctaccagatcctgaaacaaaaacaacttgggaaacgaagaaaaattgaccaacgaccaaacttttcttcacatttgaaatttgcagcgaccagatctggttgattcaaccacaaagaaattaccaaatcaatcaaacctagtctcacaaagtagtacaaaacagtccactaaactcaagctcgggtcttttcacgaaattccaacatttaaagaacaaataaacaaatgtaagttagaaattgagaacccaattgtaacgagagggaaaggaaacagaagaagaagactgaaatttgaaatctttggtctcgctacttacctgaaatttgttgttggagagccaaccaaataacgaatccagcttctaagtagagacgaagaacccaaattcacaacaattctcgaggaagttttccgattagaagaaaaccctagaatttttataccgtatttgacggtaaaccataaagctcgtcgaagtcgccagtcaccggaagtagtaaagcaaccataaatgcatgatcccaacacgatatacggtgttccgtaccgttaaagtacgcgctcaaatatgtaataacaaatattaagaatctaatctctattccaaagtattataaatgggccgaaatgaaggctttttggcccagttgagattatttccaacttctatcctcttattaatttataaacatggcctttacaaaattctattctaaacataaacatggcctttacaaaaaataaggctaccacacacaaaaaaggtccatttagcaatggtgctaaatgagaagagcttctctatttacctagcagaatcaataagtctaagagcattttattaaatacaatcctctgtataaattccattactcatccactagtataaaggttttcatttatagaaaaaaagatttttaagttttttatattattttcatcatagtttaaaataaaatttgaattgatattttattggtacgaatgcactctgtaaattaaagcacgtgagcatgtggttgatataccatactctctcttaaagtcagcaagtcaacacaatacctaactgaaacttgtcattcaatttagatcctcaaccatcacattaaataaataaaatctcatcttctaacagttaaattaaaaagttttaaaatccacatttaaaagacactagtttctgatttgtcttgaccaaaacctgtaatttatttccattaggggaatgtaagcaaatcataaaaaaatagagaccttatgctataaacttgaattataggtactaattaggtttataatacgtttttttattttttgcttaatctgtacactttcttctttttcttcttctgtttcattgtcttcatgcgactcgtcgagtttcgtcccttcactctcttcacatcaaattccgcaccaccacatccacgtgtctcaacctccactctcctacgtctctccaccgtcgccggcgtctgcagcgtctgcttcatcaattcctcgccgtctctctgaaagaaaaaaaggaaccacctttctctctctgttttgctcgatctgttgtaatttactctgtagcgatcatcagatcgccggcgttttaaaccgcc

SEQ ID NO: 4483 - DNA, 2000 bp, Arabidopsis thaliana
taaaccatatgtgtcataatgaacatagtttcggttagcgagtattagacaggagatccaactatacaataatacaagtctttttcttttaaatgaaaatttacttatggtgctaattctattgtcattaaccgatgtttcatttgagtaactgtcaatctgtcatatcatttcaagcaaagggtaaatactaaaacccttttggttgccccttttttagttattaatgaggttaatagagataatcaaacgatatgataaatgtataagattaccgagtaaagatgagtaatttaatcgattagtggagcatgcgttcatttttttaagattatacttgctcttgctggttaccaccttgttcgctcttttacgggcttaaataacatacacatattatacgtatacactatcaagcgtgcgagatagaccaagttacatgttaatcttaattgttgaatcacacatttcaggttcgtaaggtcataccgctccttatcaaatggtattcagttttatctctctgatctccctcttcttttaattgtctaataaattaaaatttgaattagaacacattaattggcaattacaaactattattctattcaagtgttttttttcaaacagttttacaattataaatatgttatcggaacgtatgcatatataataaggatatttcagtcgaactaattattcttttatgttaaatagttgattataaatattcagataacttctctgaaatgtataatttgtatttaatctgaaaaatacagtgtgtaaattaccgttttcgatacatatattgtttagctcaatgtcaaaatgacattcatgtcgtgattatttactttccaacaaaaagaagagcttagcttattagttatcattatattttagattttttttttgtagatgacgatagctccttttagatcactattagtaatcgcaattaattcaatttggagagaacaacacagcaagaggcatgaagaaactccaattccaccagagcgttgcttcaaagttcgaagtctcaacaaacatgtttggaaacacatctcctctatacataagcaatgagacaacagatatgttagatgtatgcaagttttgtttgcttcaagataaacacaaaagcagaatagttttgattggaaagttgtttatctgaaaacgattaatcgagcgatgctcttatgttgtcagtgggcttagaatatatctccctaggccatatactgggcttcactaatggcaacaatattaaatagtcagttgcctcaatatcaacgagtgttaggcgggcccttaaatgatttgaacatttgatagattttaacaaatgttatttgggagaccacaattggagtttttttttcttttcaaatttgatttcaattctgtagcaacatggaaattaattagtatgaaatcttcgatggttgaaaaaaatactaatttgtaaattatatggaaaagaatccaaaaaaatatgatttgacccatacgtcggtgtttgttgagtaaaaatcttcttttttttccgtgtttaaggtaacaaaacgcgtcgtcacagatttggaccgtattaaaaacaattgacaaccgtgtatcctcccttaatttatcaataatgcaacattttgatatattcgtctacttcatcaataagaaaagtgtaacacgggaaataattaaatagtctaaattctcttctgttttttttggtttgttcttagaggaaatctttatcttggaatctttaatctatctagaattaaaagtttatgctcgtaggattgtctacttttaaaagtcaacatattcgatacagatattttgtatatttatataaagtcgaagaccctgaaacttatcttcacggcataataagaccaagaagaaaaagaaaacattaatttcaaccaaagcaaaacagagagaaaaaaatagagagagtgaatcaatttcggtggagaaagagaaga

SEQ ID NO: 4484 - DNA, 2000 bp, Arabidopsis thaliana
gttgtattaatgctctaagaaaaaagttttctccagaataaacaatcaaggagcaaatatttcagcgccaataaatatagtagcctttaggatggtccaaatctggtaaaatatatccttagctaaaatgttgatctaactaaagagatttatatgtcaatttccaaccaaaagatttaggccctgaatggatgctgattttcgattcagtttttggattttgattttagtttctagattttagattttagttttagatttttgttaatatatttttgttttaaaaacttcaaaaaattagtttttagtttttgagaaaaataacgttgatggagtaaaaactagattccctaaattttagaaaaactaaaaaactaaaatcatgaatggaaaattacaacaaaatagtttttcaaattgtagggaaaccaaaattttaaaatcttgattgttatgaaaataagtttttgaaaaacaaaatccaaaaactcttacaaaatctacaaaacattcaagaccttattcttctcaggtttatatcttaaacaaaacaaaatccaaaatgctatttaacaaaacaaacaaacaagttctcttttgaaattaattatttatatgatattaatttccaaataaaacctgaaaagttatcataatcagatatacatttttaatgtggaaaaatcacgtaataacattataaatatatatatgtaaactaatattgtgaaatctaagactctgtatatatagtactgactactgaacaagtatataaattttatgtttataattataaaacgaatcattaaagatatcaaatctgaatctcaaataactaacccaaaatcatgatatctatataaatatattcaaatgaccttgcacgacggtctacactgagcttgttgacgatgacagattcagaaattctgattattagtttagaaaaaaaaaactatagtattattattaactattttaaatttttaagaaaaaggcaaaataaatgacgagtttaagactttggtagttagctccggtttcaatgaatggtccaagttggagagattaggttctttttcttccctatgtgggtcccattcttccttgtgtgggtcccactctctttaacgtttcttcaccgtcctttagtgccaccgttatgccgtgccgtcaactccgttgacttcaggacaacgctgctcgtcttttactgagtctcactcacgtcgtctttctccgtcaactttcttactaacggccacttaacggaaatccgtcactgttaacaattaaattaattccgctcgacatttatcgccgatttacacgtcacttttttctatcttaccctggttatttaacacgtgtacatttatgacgctatatatcgaggaatttatccatctcaaggcattttctcaattatattctggctgcaagtatccaaattttataccagttctaaacaaaattagaaagaaaacaaaataacaataaagacatacttataatattgagatcaaatctgacatttaagaaccactcaagatcttcctattttaaaaggcaaaagaaagagtcagactgatacttatcataaataattttcaacatatatatcaaatgtttgagcacataaaatataaatatcaaatataaattttaaatgcaacgctgtaaattttcgttttatgtatgtcataagaattgattagataaaattggcattttcgcataatttacgtaattagtataaactaaatcattatgcaatttcggaaattaccaaccttctaatataatattcccaacagttgcttggtcatttatttgtatgtgtaacatttgacaaaagagtgatttctcgttgaaaatggaaacctttagctaagactttacacaacttatcctcataaatttagtctttatataaagggactctcttttttttctttttcttctctctatctctatctatctctctttgtctgcaa

SEQ ID NO: 4485 - DNA, 476 bp, Arabidopsis thaliana
actagctgaaacagagacaaaacaatgagaaacaaaaaaaaccaaaggaaggaagaagaatctctcaaatcccaaaacttgtatctgccttcttcagacaacaacacccaccagagattccaggattgatgattacattactcagaaactctagaatccatggatatagtttttttttgagtctctcttatgtattactctgattatctctggttaaactagtagagttaatttgtaatttttattcaccttgcttcctgggattttaacatttttgcatcttttcacttgtctcagtaaaaaaacaaaattatactgtagctcaccgtaagataacgtacactcgtcacaggtgatcctgtcctcacaattctctctgatttcgcttactctttcactgaaaccctaatttggggtttttcagatttccttcaatctctcgtcgtcatttcttcgtctcaccgttgaatctgaaa

SEQ ID NO: 4486 - DNA, 912 bp, Arabidopsis thaliana
tgcggtgaattactatgaaagtacaaattaaaaataatctgaaacattgatgataacaatgtagcaatgtagtcgtaacatgccaacatcgaattctgggccaactatattttgctttggtaagcgaaccattcattcagtttttaattattatatccaattgtttgacgcgttttaaataaatcaataacataatccatgttcataccaattaaatatagatatgtatgtacgtgttgtcttgtcttatgaatcaaccctccttggagaatcttatgccataaagccaataaaaagttacctactctttcaatttacctcgttcgtttaatctgttttgatcaacactccccatattatcaaatcatttaggaaacgtataaatgaaacgaaaatatatgttttagttactcaacaatgttattaagggtcaggcaacaaaaaaatcttgaggggtaaaaacaaagttctcgatttaataattatagactataggtttaaacagagacccacaaattctgcatttctcaccttccaactgtaactttaatatttgtttcaaattgacacggcgggtaaaaataatcaggtgtatcctccctcacactaaggcgaaactaacatactaataaggaagagacacgtgtaaaaaagaccggtcaaagacgctacgtagataaaagtcacgaagcttgctcgtttttaaaattcaaagaggtttcatctccgtataagtaggcgacgaagcataccacgaagatcgaaaaaaaacaaatcagattctcaaatactgaaaataaaaagaagaagagagaaatctacggtggtgggtgattcgccggagttcaatttcgtagctagatttctcctccttttccccccgacgagctgtgcgagagagggaggggaatc

SEQ ID NO: 4487 - DNA, 2000 bp, Arabidopsis thaliana
tgaaccatgttattgtttttctttgtaccaaatcaagatttctatcacacgagatctctagggatataaatccagggttttgtctagctatgataattggttccacatcgaaaattctttgggtgtagcatgtgtatgtgaggtagtggaacatgaggaccgatcgtggcctaacgttcgatcttctgaggaaattgcagtagttgaagacgctgattgaaacaaacgaaggtctactagatataagaacggttgtgatatacattcagacaaaatgaattaagaatttatcagctagattcacggaataggaatctaacgaaaaacaaaaatgagagtatacgattcgaatgatttcaaaatctgaaatcggaaaatataggcccattgtagcccaatattgaccattatatattagcagacggcccatgtatgaaactacccgtgttcacccaaaaacagataaatattgtgatctttcaactccaaattataatgtgattttccaacataaaagaaatatatgaacgggtgagatcctgcgaacgtcgcaaaaatttgtttcttacaacatttatatctcccagcgaccactacagacaaaaatttaatttagattaaatgttgccgaattaataatagggagtgaatgtgtgtgcagcaacacgtgcaaagcgtgatcagcacttgaccagagtgacaaacctaccaatcaactttgcaatgaattatttgcgttctcgtaactgtaggagtaatttaaatacttgcatatgaatgattatatagcctcaatcacattacattaatgattataaacgtacctttcgagctctgctgtttaatagaagaaaattatataatcacattacattagtttgttagttttaactacacgcaatatttctataaacattttttatatactcatatttttttatcttatttttttttgtaaattgcatgtcattgtgagttaactgttttttttgtaaaacagagtagagattgaagatttgacaaaagttttcaggtatggctctaagctcgaagaaccaattaagctgaaaatgttttttttgtaatagatgatttagatgaacgatcctaaactctcgttagcacttgtaacaactttgatcacttctttttgaatttaatttaacataaaattcaaaagaaaagaagttaatgtggtgttatataagagtaacattacgttttaattaaaccaaaaagaaaaaagacattcagttttaatggacgaaaccgaaattttgaatttgacacaacgcaataacgcatgcatgcattttgacacgagagcacactgtatgagaaatgtaaacaggtactattggtttagttaggtgcagattcaaagactacttattaatatagcaaacagattatatatataacaaaaaaaatctctctactttttttttaataaaaaaacagagtatataaaaactactgactacatttgttcacaattactagttaatataccataatattgaaaatatagagactagtagctaatgactgtttgatgtcattgtcgtaacatcacgttagttggcgtacattcatgcttctttggattccaatcttcctaaatctttttcttatatagtagccttgtttgttttttttacttcgctacacttgtgtatgtattacttcttgtaaagcatattttcattattaataatatttacatgtttagaaaaaaaaaacatcaagttggttacaccaaccatatatattttcacgtatgtatcagacaaattactaattacagtggaaactgtattaacaatcatagcttttatatatatagcctttatgtaatttttggttttcatgttaaaataagccaggccctaagagagtgtcatacccttatatattgtttactgcatattcacaaaactcaaatacagagcagaaacctttaagagaagatctaataagaaagaagaggaaaaaaaagg

SEQ ID NO: 4488 - DNA, 899 bp, Arabidopsis thaliana
aacaaagccaacgagagtttttaaccatatgaaccgttttaatgtttccgcgtctttgtaacgaaaaccaagccaagtctcatctcctttgatttcagaataaataaataaaatttatttatttctcagtgttgctatgacataatacaaatacattagaaaagcccaattatttttgttttctttgttaaaattcccatatttcatctggtggacttaaaaaaataaaattatacatgagctatatattattctgctaaagcatactttaaataataaaaatttaaattctatagatatattttgtgtttcggattaaaaagaacactccaaatcatagaactaacaatacatgattttgattatataaaaaagaaaatcaataacacatgattttgtttcgatatcaaactccatgaaccaaaaaaccttataatgtggaaggattactaagatttaaatattttttttttctttttaaaacactttattaaatttttgatatcatttatattaatattttgttgattttagtttaataaataaattagtatcaaaaataatattgtagaagataaatgttactttagatcctatttctttcactaaaataggtacaagcatttatagccattaattattctttgtatagttaaaaatcccataataattaatggtggacccgtaaaggttgcgaaaagtcatacacgttccaaaacaaaaagtcgcaagtctacattttccttcttccagaaccataacacgtctcctcccatttcttcgtaaatacgtttctcctctctgacccatcacgatcacaatctaacaaaaagagttttcaacaaaaatcagcaatcgtggcgaagctatataagaaagaggaggagagacacaaagcg

SEQ ID NO: 4489 - DNA, 1931 bp, Arabidopsis thaliana
cgctgagaatttccgacgatcggagattgagaatctgagggtttggtggaattgagaagagaaggtttgtgagaatttggggaaaaagatgcgatgagacaaagttttgatgatgatcatagtggtgaagaagatacagtcatcagcgacggagatagagatggtaagtgaaacactctttctgcttcagaggtttctttagaccgtaaagtcacttttgttgcctttgtctcggtccatttgattcgagcggttgagtccatgtaattgattttaaattatttttatttgacagaaaaaaaaaaaacatgttcgaaaatcagcattaaaataagaagattttaagatgatttatttaatagtgaaaatcctgaattaatagccaattggaaactaattataataaccaatctaacaaatggcttattccttacaacaatattaaatcgcaattaacacatatgcggtttacaatattactttagacaatatatatgtctaactagataaggattcgcatatatgtgagtttttggtttaaaattttcataatcggtgaaaaagtaaaaactaaaattatatgaaccacgaatacaaaatcacatcatcaatctccaaagtattaaatagtgcacaaaatcttgaataatatttttctaatctattctccatcctggagattataggtgaggagattcagtggggtgaagagattgagttagtctttgttcgtcgacactggatctcgtaatgattgttgcgagatcacaagttcacaactaccttcaaaaatatttgtttatttcaaaatttggtaactacttctcatcgatatttttaaatattttcagttatcaaatttgttttgagtttttttaaaactacccaattatgtgataaaaataaattaaaaaattataagtaacacttagtcgttgtcttctataataatcaattataatatagaataccccacaattgtataaatcatcttacaattcgacttaaattttatatcaaatttttaactatttaaaattaaatttaattatccaaattttaaattcatatggcttaataaaaacaaagatcttcatttacaaaatatctattaaacatattaaatgaactaataaacaaatatcataaatttggacgtgtcttcattcgatttttaatcaaattaatcttatttacctaaaatcgtataaaaaaggttcttaatgtttactcaaatcatttatttttagttaaatactaattaatctatttttcgtaatacaaatcaatataaaaaaatatctacctactatgtattaaattttgttttagtttactaatatttttttatttgtttaaaagaaaaaataattataaaattataaataggcaaatagcgtagataagtaagtcgactattgtctcattttgccgtcaacgagacagaccacagccgtcgacgtcgtcaacaccggtcacaaacttagattccacaaaaatctaacgccgtcaattatttccgtccatctccttcctcaaatctctctctctactcttttaaccccacagaccattcttagctgtacaaagtctctctctctctctctctgcaaacactgattcaacaaagaagaatcaaaatctccagaaattcgatcgtcgttgaagattcgtctcaggttcgtctactttgctccgtttctcttctaaatctcctatagtttctggatctgtatgttattagtcatgatcgatctcaactctgtgaaccgaactagaatttgttgtcaaatctcgtgtttacgttagactaagcgaacaaatctgtaattcgtattgttcagaacttgatttcgccattattgattcagaaaactgatcctgagttctaaagtttgtgtagtttctagcttagtgttttggaatcgaaa

SEQ ID NO: 4490 - DNA, 1399 bp, Arabidopsis thaliana
ctctctttcatcaccatgaatgttcatcttcttctctacctctggcatatgacaaatgtaggatttgtagcaaccagagtttatcaccactgcatgaattcgacatgtctttttcttccgcaactcagtttgtgtctaaatcatctccaaaattctgagatatagctagatttttatttgttatgaaattttttttaatcactgttggtctttggagcctaattatcgtgttttgatgacgcaatcactgcgtcacaatctgatgtcatcttaacaatcattaatgtattttttttttcttttctcgtaatattcttaattattcttcgacagcaaaggtttaaaaactccttatttcaatcattaatgtatttatgatttgatcgaataacaataatatagcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttattttttttccatctcttttacttctccaaataataacaataaaagcttcgattttgtgtgtgtttgtatttacatcttgacatcgatattcttttcatcaattttttaccaaaaatgtaataaaaacaaaaaaaaaccaacgctgaacacagacatggtttctccatccgtttatattcatcgtttgtatgtttacttaacaacttatttcaaaatagtacatatcatggttgtgtttttaaaaaaagtatacagaacagaaaagcacatggtagacaaaataatgaagccaaaattaatacaaagaagaagttcaacttgtatttattaacacattttctttccttgtcaaagacatgcaaattggttttgttttcttattcccattttttttttataataaaaagaagaagagtaaaacaaaaaaactatcatttcttcttatcgcaaaactcttatctaagcaagaaaccgacaaaacctatatctacatatattctcatcaacatctcttgagacatattcattttggttaaagcaaaagattttaagagagaaagggggagaagtgagagag

SEQ ID NO: 4491 - DNA, 770 bp, Arabidopsis thaliana
cttttcttccagaaactcgagatttgaaataattaatgtttaagaataagatctttgcttctatgcatatattttatatgcgtgtgtgttgttaaacaaagtccaagactaaacgggaatagtaggtgcaccaaaacctaactaggagttactttgacttgtgaatgctgacattattagaacattagacttctaatatgacttagattcatagaagataatacgtaaaagatttagtttctggtatttttccatttttttttttgtgtatttccttttttttgtttaatagaagtaataaagaatacggaggataataatgacaatattcctgatgagaaagttgataattttctaaaagtttcacaaatcttgagcatgtatatattgtgaagtgttgtgttcattgtaacgtcggattgattgcatgaattaaatgaatatgacaaactatttgagaatgtaaataatgttttcttgtcctacgtatgacattatatcatctatacatgaatgacgtccatggcggttatatttgaataattgaaaaatacatgattttgcttcaaaaatagattgacctaagtccatgattttgctttaattaagagttaagacaaacaaaaactacaatctaaataaataatgataaaaaataataatataaaaatatttttagtaaattaatcaaaaaaaaaagagagcatgtgagctcacacataagacagcaaaaagagctaaatgcagagagcttcagatccgaccaaaca

SEQ ID NO: 4492 - DNA, 981 bp, Arabidopsis thaliana
tgcaatgttactcgaagcaactgtcaaatcaaagcaccaatgagcacattaaagaacacgagaagtggaatttgagaaaagaatatctcaccggtatgagattttcctttcacactctcgatatcagaagcaacgtcatgatcgtcctgaagaagctcggaacaaaattgagcattaaagagagtccaaatcttaaattaaaagcagcagaaagacaaagtgaaatggaagtaacgaacctcatctttgattttccggtactccattgtttcaagctctcagatctctgtgatctcttctccgaacatacacactcgatagctattaaaaaaagaaagaataaagtgcttaatttcgattttgggcttgaaatttattgggccttagtctaatacctgattaggcccgtctgggatatcttttttcttttttggatttttgtatgtgattgttcttttttctgtcaacataaatttgcttggctatggacattggacagattctgctacatttttctgatttttattataaaaaaatcaaagccaatgcaatttcaacagatttctgtactgggaaaataacctttaaaataaaattacaaagaatttttttaattaaatttgtattgtgacttgtgatggaaccctacctgaaaacaatgtttatctatattcactaaaaataaaattgttatatttccaatattataggtgcattcattcatacacaaaacaactaactatacaaatcaacaaataaacataacaatacaaattatttaatacaaaaacaaacagcaacaacaaaatgaatgtaattggctgggggcataaaagtaaatggaccccacaaaaataaagtggaataaaaccccagcctgtgttagagctgtgttcactaatcaatctctcacattcacattcatcttcttcttcaatctctctcaacacaaagaagaacaaagaagttatgagctcaatg

SEQ ID NO: 4493 - DNA, 1571 bp, Arabidopsis thaliana
gtccaaaaccagtctctcacactaaagaaacactttgtcatatttgtacatactgagcggaatattctgagggatttgttttgttttcaatcagcttgtagttgattattgtagttgcgacataatgaaaagaggagaaatgagagatgggttcaaagaagcattccacattcagaagtccaatctcctaaaagactaaaccagccaaaatgaaaagaggagacagagccacacatccgagacgatgggccgaaacacacatagtataattgaatgtgggccgtggcccaatattaaataatcatcccttgattattgattatctatgacctcataaacgataataattactaattagtactctacgaatgagaaatataataaaatagtcgttttctagtgtgtttgttaagttgttatagatcaatatacaagtatcattcattggaagacaacaacatgtatatatctgagtgggaatgtggcagaaaaaggatttggataaaataagtacacgaagaaaaaagacagagtatgtaatgccgttttggtaggatggaaacagcatgcagttgttttggcaactgtattgtagtattagtattattagaaaatccagctaagagattatattagactttacccatatctaaataagtcatccttccttacctttttcatatacaaaacaattaacacttgacctaacttgcaacgctctctctcgattccatccttttttgttcttttctttttgacacttttttttttctttctttcttttcttaaatagattattattcaatctttcctcctccatataataataaaagtgattgtgactgatatcaaattccttatttaaataccacaatcacacagatacaacatattactaattttaaattacagagcagttggtccacatatgcttgaaattgatagtctaattagttttaatgaggaggtccatgtcaaataggcctgacccactagctatatatataccatgcattaaacctatatataaaaataaaatctctataactttttttgggagttgttaatttccttttcgttaattatagaatatgctccctttctcttctctgacgatggttcataaacctattccttcgtagttgtttaacgtccataataattgtatacttttagttcgagatttacctaaacaaaacaaaaacagaataccatactgtatttcatgatttctgtattggaaaataaaagactgaaaccaaatgattggtgggcttttctaaaataatagtaataaaatacaattaagacacacaaaaaagaaaaggatttggtacatttattaacatcgatgatgagttgataatgccacgtaagccaaataccattttcccaagaagctcatatgaccttcttttttgtgcagcaaactccacattccacaactctctctctctcatttcttcgtataaaaggaaatctatatcatctctctctctcattgtcaaaactcaaaagtatatacttttactagttttagacttaataaatgcgatcgccctttttttagt

SEQ ID NO: 4494 - DNA, 1413 bp, Arabidopsis thaliana
caccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttca

SEQ ID NO: 4495 - DNA, 2000 bp, Arabidopsis thaliana
caaaaagacgaataagttagtattgaaaaagataggtttgtttgatatgtgtgttgatacgtcacggttcgtgctacgtctttgttaaatttagagaccagagattactgatgtggcacgtcggttcattttttttattttaggcgaattttaagagatgatgcatttaccgattaccatctgtccttcattaatatttttagtatatctttttcaataggtcgaaaatgacatcccacacattaacatattaattcataagaaatccaagtcatcttatgctcatttgtctactcatgatttcattatctacatctaagtttatctttaaaaactgcatgaaaacataaccatttacgttgaaaaaatacatacacaaacccttttcccataaacgagattacgaaagattgttttatgtgccccaaaaatggtaaacaaaagatgatgctaactttctattcgttctaaaatctaaatctttagttttagtttgtttatgtccacgatcatttctttgataatacttttggcggattcacaagcgcaaattacccgtcttattgtagcattaggactaaaaatgagatccggtagcattgcaacaacaccttcctaatcgattgagccaatcggacttatattacttgttggatttgtttttttttttgtttagagtatccaagatcatgtatttacaatttcaaagatcatgcgttactagattggcctcttcaacatgtttagtgaataataagttaaaataacacctaatcgttgaggattcatagcgtgataagaattaaataaccaagttcttattggtttgtttgtattttgtaacgcatagaatagaagaaagaaaaaataaggaacgttataaatttctaaaaaatcatcatttcttctcgaacaagcttgttccagcgtggcactagtcaataagtcaagtggacccacgtaaccgacatcacgtcttttacgccaatcagtacatactattgggtcctacaaaaggacaacttcccatgttatattgacacgttttaagatgtaattgattaatctaaatttctctctgactcttttctttgtctacatccgacgttccatttctgactatgagctccgtcgtccgatttgcgctaatgcttgacacgtgtcttccaatctatggtgcattaaattgttaatcctttcaaaatctgtaatccatttttggaatttgcaagatggttcctatatttgtgaatatatatatatatataagaaagcccgaaactttaagaacaataatttatagggacatcccattctttaaaatctcttttgcgttgtcaaaaataaattatttttgctttcagaggaaatgaaaaaacatttttgcttattccatattattcttactctatttaaagtttgaatcagttttctttaacttgataaaccgatcattgaactacaaagtccacataacaagtattaaaacaaacaaaaaaacttatgaaagtctaatatttaaattaaaaacagtacacgccttgaacaaaccatttagtttgttttcactacttttgaaaaaaaactatctagttgccattcttatccattattttttattccactaaattgatatcagatcacgtaagcaaactattaacaattaattaatgaattcttcttaatccaatataactttatctaattaacagaaaaatgataattaacgtggggacgaaggagaagatgccataaaaagcgggtcattttgtaatttcatataattagatatatgtttttaaattgcaaaaaaaaagtgtacaaagagcgtgaaatccgcggtggcttggacccctcccgagtcctcaacactatataacacactttcttctctaatctccatcacctcttattttcatctgcttttgaatttcaaaccttcacataaaaaaaatacttttgaatccgtgtttcattcatcgaatctttttccgataact

SEQ ID NO: 4496 - DNA, 2000 bp, Arabidopsis thaliana
acaattatgtgtattggctgaaaatgttgtattattttctaatgcaacatttattaaatttcaagaaaaataattaaatactattggtttagaacaataagaaattgtaaatcacaaaaaataatacatttatacttaacttttactattttttttatttgttttaaaattttagaaaatatattattaaaaagaaatagattaataattaagttcatttttaattggttgatgttaaaaggaatcaattatggattttctatttttttggatggcatttgtggattttgcctctttttgaatagtttgtggattttatcatttttaacctacaaaaatataatttaatatgtgttttatcgtcatatttaggttagttagttgtaattgttcttaaaatttagtatttggtataaagtatatacttttaccaaacaaatccaaaatttgtatattttttaatattaaaagtggtaaaccataaaattttagtaaaaataataattttaaaaaaaaatcgacgaaatagggcaaaatcaacgaatctctgtaaacagtaaacttataggagtagaaactaaatttttattttaatatagttagaacctgcataggtcggaccctaaaaatatgttctggatttaattatttagaaagaaaaatatagaaaatgtatgtatgtcaaaaagtcttggaccataattggcggagagagaacctggggacggacaaaaaagtgacaatttgctccgacattaaagataattaatgaaatcaggtataattaaatgaacgcataaataaatgaagagagatgatgatatatgtataatcgtaaacgcatagagtagagaggacacatggagccacccttgtggtgtccgacaattacttttaataatccttccttttaatgaacttctattattttgcttagatatcatttttttttcttctatgtatgataaagttctacatttctggtttgtaatcttctaatattttgatagtagagagttggaataccataacatgttggaaatgttttccattttgaaaaccaaaacttttttttttaaaacaatttttagctatcgttatcaataagttcatcacttaaatgtttttgggaagttcacagtattttggaagatattctattaaatatcaactatttttctagttttgtgtgctaattttttcctcggttatctaatgttgtggttgattttattgcaaaactatgtctaagtttgtatggttagaacatcatttgagcaatataattaagtttgtgcaaaaaagaaagttgatcacttagtattaatttttcattatataatttgatcaagatgcttgcttaatccgatctagataataaacaaaattatctaaacagtatgaaactacaagttcctaatagttaatgttttgacatttacaaagcaactaagtaaaatgttattaatgaattggttactttttttttggtaaaaagttaaattcatatcatttttaaatttttgacagaaaatacagaaatcacagaacaaatgaaaacacgctattgaaaaattaaaaacaacaatattattcaaaaagcttttggttgctactgaatgaattggttacttgtttagattgggtaacaaaattctaaccaaaactagaatcactaatactcattctttaccaaataatacttcaaattcaaataagagtttgattgtgaaagctgtatagctgtacgtatcatgtccatattacagttgtaagccattgttacaaaactactaaaaacaaaaataaataatagaaaggtccgagaaacttgaataaaaatttagaatttttaaaacattattatcgtaaataaaaagagaacctcccaagaaacaagtcgtccttatataaagccaaccacacccctttagcttctctcaccatcatcatcatcatcatcatcatcatttctctctatctctttctaaaacacaacc

SEQ ID NO: 4497 - DNA, 2000 bp, Arabidopsis thaliana
atttgaaatagcagaatatgaaatcaaattaattttattgagatggaagctaatgaactattaaatatgaagaatttgaaatcctttaccttttgcttatgtgatattaccaagctatgatgtgagtttgtatgtgatatcatgttttatatgtaatatttcgaaaacaaatatataaacaaataaagagaagcaaatgaaacaaaactttggcttttttatatatcatttgtcatttatcatttacaaacctaaaagtcaaagataaaccaaaggataccctgatttgttaatgttatgatatttgagcaaaactgtggagtataatatattataactcattgaatataaccacatagtcataacaaatcaaaataaaataaaagtttccaaaacgtagtcataacaaataacaaaattatttaaaggttttcaatttttacaagataaagtatattaaaaatgataaaatagaataatatgtaactttgttaacatcttggaaaaaatagaaaatttaatatgaagttgtgtctacgaattctatttatgttctagttattgtacatattcaaattaacgatgctaaatcattcttctgatattgagttgtgtcacatgttaagtatatttattttaattttcttagtatcataatgttttctttcttgtatgattaggtgcacatggaatatatgtcatactattttaaaattcatattttattaattcttttgtcatagctagccatcatatataggtagaccagtatataatagaaaaaaagaacacattcaaatgattttgatttcttctaacactagattaatcttaacttcacctttttttttgtcacagttaacatcttatataacttcatttcaaatgtctatattttttaatgtctacataaatatacatttcatcacacgatttacaatatgaatacatgtttataagcttttagatcatggaatataaaatagtgcactttttaattatgtcgatatagtctttgatttttaaaaaattaaagatgaaaaattagaaaattatgtgatgcattaggactcaataatagagactatacataataacaattgcagttagttcttagttggatataataggtcagtaaaatatattattacaaacatcaactctgcactacgcaagatgtagtaaattacgaaaatatatgataaacaaattcgcatactacattatgactacaatagccaccttccctatacattatgacttctaacattgaaaaaatttgcaaacatttggtgtaaattaacaaattaaaaacatttggtctaatgtatgaagaaaaaactagatattccgctaatttaaacaaacatttggccttataagaaattttaggtaagaaaaaattctgagaagtcttttttattcacatcacatagtcaatattcaattcaatgcatataaatttcatgtaaagcttcttttttcctcggatcccattcattattttacttaccattgaatactttcaccgtgtagtctttttttagaaatcgttgaatatcaaaaacaagaagaagaaaaagaaaccgtgttttcaatgtgctgtcatacgattcatgaccctttatgaatctaatacagagtttgaaacataaactaaacttggaagtttgccaaaaaaaaaaaaaaaaaaaaaacttggaaataacacttctcaaaaagatattgggtcaaagtctaaaactgaaaacgaaactagaggcattattctctaattcaaacaaagtttagggcttgggaagaaatattcacaaaaaggaagtttccgaaaattcttttatattattccccaagcaaaccattcaatatcattgattattgatataaaacccatataaaggtgtctctcatcatcctccattcccatacatcactttcctcgatctcactttctctctcttatcatcatctcctggtattctctctctctcatctccgtg

SEQ ID NO: 4498 - DNA, 2000 bp, Arabidopsis thaliana
atattacacaaatacatacgaacgtaatacctaacctaatgaaaaatatttacatataccccaaaaatttagaaatgatagtcaagaaatacaagaactctagaaaaatacatacattttctatttatttgttcatttacattcttaatttttacaaagatccaaatgctatatatttttcttcggtctacaaatcttgtttagacaaatccgtaccccaccggaaatgaatcatatctattaaaaccggaaaaacggtctatttccccacaagaaataccgcatcatgccagatagagcccaaacttcaaccccggtctacatgtccatgaaaacaaagttttaaacctatttctctccgaaacgtaagttctatagctaaatctccccaaattaatacttcgagatctattagcacatatatctggtttttgtcggtttaatgtacaccaattcagtcttaaccatttgaaaacaaactttaaccaaaactaaaccaaaattatcaaaaagtaacccgaacccgccgacctattaatgatccgatccaacgcttcttcttcacctgaaattttgcttggattatcttcgtttaaaaacaatactagactaactttttcctgatgaaatcaatgatcgatcttggatgcaagtataaagagactttcctcatcatgtggggtattaagtatacttgcaccaaattaataggtcggcgggttcgggttaatttttgataattttggtttagttttggttaaaatttgttttcaaatggttaagactgaattggtgtacattaaaccgacaaaaaccagatatatgtgttaatagatctcgaagtattaatttggggagatttagctatagaacttacgtttcggggagaaataggtttaaaactttgttttcatggacatgtagaccggggttgaagtttgagctctatttggcatgatacggtacttctcgtgaggaaatagaccgtttttccactaaaacccaaactagaagaaaataaataaatagtttatttttatttttatatgccaatagtttttttctttcttttacatcttaataataaatattcaatcaacaaagttagatcgaacactttgagccagatctgttatttttggggtcaaactttaaaaattttaaaataagaatataaaaatatatgcttttcttagagatcttttcttttctttttgcatattaaaaggaaaggtgttaaaatcacatcttttttatgagctggatagtcaaatttatatactattccattttttggtcaactattaatggtactatttgatttatttctattaaataaataaaattaattaattgaattgatgttataaaaaaataaaaatttggatttatttcttgtatatattgtaaaataaataaatgtattgtattaacattaggagttggtgtatattgacacttgggtcctttagtttgtatatatattgtccataaattattgataagataggactaaaaacagtatatgcttgggtacaagccagtgggtaattccaatttttattttaaaagaaacagaaaaaaaactctggaattttgataacagttttccagctacccgaacgtgatttttgcctgtaatcacgtacatccataaagcatgtatatcaaaacagtagaataagtcaaaactaaatttcgagccctgtgacacttttcctctttacgttggcatctatatttaaccttcttcttttttttttactggttacacaaaatatactttcactattgcatgtagtagatacacctcaacccttacgtgcccatccgcaacaacaaatatcatgatatttattatttactgattccttatgatactttgttgcagtaaattaaaatcactataaattagaagagaagcatcacttttattcttctccattaacaaaaaagagagagagaacctaaaaagaagagaagagaaagagagatccgaa

SEQ ID NO: 4499 - DNA, 588 bp, Arabidopsis thaliana
agagactacaatttattttagatatgatcgttacaaaattatgttatgtattgaaatttaataaagtgttatcatatatataatgatgaacaagtatctgtttaattattaaccagataaaataagtgttgttttgtttcaacagtaaagattatgcatacttgaattcaataataacgaaacaacatcacttatatcaaaatttcaattttatttcacagtcttataaatcgttggccttattttatgttttggcttgagtgttgaaatatgccactagttttgacttttatttcacctacacctcaataacatctcatcttttgaataaaaaatattatcattttgttaggctttatacataataaatacacaaattcggcctcgagatcgcccacttggaaatcttcacatgcgaggcagatctttcgacagttcccacgtgggaaaatctgatcataaggtcgagccaacacattgttaataatttctataaaacggagtcctataagcgtaaaggaatcatattcctatcaatcaaaaatacaaatcgactttcatattttctctgcataagagagaaagaaa

SEQ ID NO: 4500 - DNA, 1234 bp, Arabidopsis thaliana
cgaatgtttgattatttcctaattttattatttaagtgtgcatattcacaaagaggtcctcgtttgatttttaattttctcttttgaccatgtaatactttttggtgatattaaattcacttgtgttttttgtcttttttacttttccactgaaatgttgtgcaaagtgtaagactttcgaagaaatagagaatattttaacgaaggggatcgttttgtccagttgcattcttgaagaaatcaatgatctcggtgatacaacaagagtaagaactctctggtgattcattgtcacaagctcttcagttctcggtctaggtcagtttccaatgtgctaattaggtctttagttagggtttagtagtttaaacaggggattctaacatagactatagctttgatgcatgtatatcttgttaaccaagaatgatggtggctatttaacaggaaaagattcggtgttaactcagtttggtaatagttttctgatgtttcttggttcattccccactttccttgcaattcaagtaacatggcttggctgccatcagacatataaggtctattcgtcatgtctagattgcgcttgcctattttaagcacgtattgtgaaatttccctcttgacttccaagatggaaaactttttgactagagaaatcagttctgttcagtttgagccacaacaatcaacattctctcttaattagtccacttgttgtgcctagtctgctattaagtaagtgcctggaaacaaggaattgggagtataagaatttcttaatattcgtttttcatgcaacaaagcaagtaaagacaagactgttgacatataatgatatgagaatgtcgacatagtttcttcatcctcccacataatacatatgatataagtagcgaatcaaaccctatgcacatactccatttctcctctctcccttccctagaggaaatagagaagctcttcaagtatccgatgtttttgtttaatcaacaagaggcggagatacgggagaaattgcatgtgtaatcataaaatgtagatgttagcttcgtcgtttttactatagtttagttctcttcttcttcttttttcgtcattacaatctctttcttaatttacttcttcttgatagtataattaagttgtttgtaataatctgtacaaagatgttgtgttctcataaaaaattcaattttgtaaagaagctctacatgttccttgctctgtaaac

SEQ ID NO: 4501 - DNA, 2000 bp, Arabidopsis thaliana
tcataaaataaatcgagtatttgtaatccataacttaaaatttctatatcaaaagattacgtacgtagagaaatcaaaatttggaccccgaatataattttgaataatcatatattagcttattgattctcattttataacattttcctttgtcatatagtgaaattgagacacacacaaagaaaagatttttttttttaagtataatacaagaacatttttatttagaccatgctaacatcttcccaattttatcagatgtcccaaaagaacctaatacaacaacatgcatgtaccaattcatatcacatagacagttaacacgaaagttcgttggtttttgtaaggaaaccaataaagcatatttgtcttcagcctctcatactatttgagaggtaaaaaccgagaccattaggattattctttatagaatgttttggtgcctaacaaattttactggcatttcttttttttgccataaactgttaagaggtttatttatgaattgttaacttaatttctttgatcaaacaatagtaagttctataaatgtatcttgtgatctttgactatgatagacactaagctcggactcatgtacatagccaaaacactcatatatattaaaacaataatttcatcggtaaactcatgttgtttccaaatatacaagtagagaaaacgtgtagacttactctgaagggacacgcatatacatactgataaacaaccatcatggagaaatccgagccgtttctctgcaagccaaaccaaatttgacatatatagtaaggtcatgtgctctatacacctagtacctcacattcatttgatatctcctctagagatacatcgatcatagtcatattttcagctttcaatgatgatttagtcattaccattcttgaaatatattggtcgagtttagtccatagatcttcgatcctgtcgtgacaaagccttccatcaattgtcaaaagatctctcacgtgtggaaatactcgatgcgtgttgctaaatatgtgaataaaagaacgccaaatttatagaaaaagcgaattaaaattcaagtaaacatatgaatatttttcaagaaaagtgaattgaaattttattttcatgaaaacttactatttttttttttttttttgaacactcatgaaaacttactattaactcatcaatcttatgccattcgaccacgatcgatagtagaggcaactattatggtacagttacgagatggacaaacaacaataacttgaaaaataatgattttttgttttgtttctagaaatatacacatacggatcttgaatttatctgattgcgcaactagagatatcaacattgaaattcattcgcccaaatagtcaatctggcggtcacatgtcagctaacttttccaacaatgttcattaattaattaacaatctcaaagattttgtagattgaaatacaaatcttctctctgtggtacatttcttgaaaaatgggaaaatcaagaaagtatcgaaaatgtacaaaaataaaaagaaatgaatcaaagtagccatgatcttgacaacaataatcgagagagatcgtcatgatacgatttccctcatccaaaattgattttatttcccttcccaaatcaaacatatcatatgatttcaccactcaccattacttgactattctcaacaaaaaaaatattaaaaaactttatgactttgattttatttttatttgaagtttagccaaaatttgaaaatatgacttttgagaagaaaacagaataaacaaataattagccacgcgctatcagacagacaaaatcccacagatatgcaaagatctctcagaatcctctccccatatcatatttttctcttttccctctccttctttcttcctttataaatccatttattctcctctcatctctcagcaaaatcaaatcctcatagttgattctctctatctctctcacgagtcacgatcctactcttcttgat

SEQ ID NO: 4502 - DNA, 2000 bp, Arabidopsis thaliana
gatcttttgctgaaggaacagggaaagagacaaataacacagatcagcacactcatatatagctgatatgtaaccgagactctctttctcgtagagagttccacgttgaatatgattcccatatcttgacaagtctagttgcaattctgaattaattaatatgaatagtttacattggtaatgcgaagaaaaagctctcaaacagttgtcacattttgtgttctagagaaaagcacaaagtgattattaacatatttgaaggtttcatctctcttatctgtgtgtatatcagttatatataatgtttaaaatgtataaatcatgatttcgacaagcttcaaaaatagtttcttcgaatataacagctggagatggattgtcgtatgtgcattatggtctacagttggaattattagagtaaattatatatcgggttcataaaatacgataaaattggaccaatctataacgaatttgtcctcactcacacattaattatgtcgtgtgagcaaatagatcacgtgagtgatgttataaaaacaagctgtaatatggagtgatcaagattcgtgttaacatagagacagattgctaacacatcgtagacatgtgatacgatcatatgagtcatgcatgtgatacgaccaatttaccaaaaaacaaaattttaatttaaacaataattggataccccaaggaccagctaattaatagttattaaatgagctcacggatcctggacaaaagtgtaacgattgtagtgtctttttttcttggtaatcagagttttatcattaggatataggttaattcgtatcaagaaaagtatctacctaacctaacgcattcgagaccataacaaaaaatcaacgtcacggacttatacccggaccgagagcttcaagccttcaaacatttcattggctatatttttccttaattcatgattcaatgttatactacacagtctcaattctatgaaaacaaatctgaagtcgtacggagagcgagagatacatacgattacagtatatgaaaaaatgttaggtgactttcacataaaaaatatattataaggagctggcctgaccctacaacgtggaaagagtgaaatgcttgtagaacttattaaggatatcacaaaaagaaaaacatctcagatatatgagttcaagatcgcaaaataatgatctcatggcatttatattcacatgtactcatgtagatctggatctataaataattgtagtttttcattgtgataactgatttgagaaaacaaatataaacgcaagaaaaattgtgatgttacaaggtgttattggattataatttaaaagtaattttgatgcctttactaaaatcatagaaagtaaataaattataaacaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaa

SEQ ID NO: 4503 - DNA, 2000 bp, Arabidopsis thaliana
gaaacaatcggacgatatgaacattatagttacaaactagtaaaaagctataaatatgtaaagtgaaaactatttaaaagggtgaaaattaaaacgtatcaacgttggagtgtttcaaaaatatttggttggataagctcaaactagtcaaattgtctcccctcccaagcgggaacatcacgccatgtccacaataaatccatttttctttctctcaaatatatatagagatacatacatcgatactattctatatattatgtaacaaattagaaatatcatataccacatggtaagttgtataaagagaattattagtgtttgcttattgcaaaattaatacaaaacattttctattgaagagctacaaattaagaaggaaactgaaaaatataataaaaagcagaatatgttacgatatttgtatgagtgtatgagacaacagtatcagataagatcataatccttgcgaccaacctatccaaaagtctcttttttgttttctaatcaatttacaaaacatttaaccaataaaaatataaagatggtgaaaaaaatatggtcatacaacaattgcttcaaagggggatgaactaaaatataccaaaaaaagaagtgaggataggttcatgtgagcccccatcccacttgaccctcttggtaggtccacatttaccatgaacatgtaacccattggttattcatttgtatgtattgttttttgtcaatgacttaattttattttattttcttcttctctgacttttttttgtttatctgactcttctatgtatgtcaaaatgtagcaagataattgaacatatttggattgttgaaaaacatatcgatatttagtgaattagtttctcctccaagcatctagaatgtcataactgtgttgaattgtacataaaatttgatatggattgatcattgataataaatcaatgaattaatgatctattagaatatgaacttttcattcaaatttaattgataataagtggatttgtctatatgtaatattttagtcaaaaaaattgtttcttttcaatgcgatattattatccttaaaacgttttctcgagataatttttttccgagccattaattttagtatgttcagatatagatcgacagaaaaactataattacgtcggaccaattgtagattggattgaatacatatggatcagattctaataccatattagaatatgaggtatctaattcaaaaccaactattaataaatagattgactcatatatgtcttatatactagtcaagatttctttgtcttttctaatgtgggatattattatccctaatatcatgaataaaatcaagagttaatgtttaactatatctaatctatactacccatcttttttcggaaactatatataagttataaaaccaagaaattctcgttatccaataaaaataataattttgactatggttatatatcagtttcaacaacttatatgatgattgatgagaaccttattttatgaaagtacgtggtaatgtgttgtaagaaaatgttcttacgccgttgaaatatttttccaaaaaatgtacataacaaacgtacgatatgtatgtaaaagccgtggtactacatttatttttgtctgcccttctcggaaacttccttcaaagttatttttgccgttcttgaaagcgttgaccctacctttccatttttaaaatgttctctcattttgacccatttttttccataaaccaatcaaattttaactttcaaaaacataaaactaattagatataaaataataacatgtacatgcacttgcctcgtccattcctcacatcatcatatgtctttgtatatatatagatgaaccaaagaaatgaaaaagtaacaacgtcacctaaatctctctcacccaatttgtgtttcttctttctgctaaaaggttataatttttgtttcttggtttggtgagaatcttcaagaaactgaaacaaagaa

SEQ ID NO: 4504 - DNA, 613 bp, Arabidopsis thaliana
caaagatcccttctctgtgtgttttcgccaaaacatagcaatttatattagttactaagagcaatacagtgtttctccttatccaccattgattgtaagttgtaaccaaggtgttgaactataatttaaaaaaacacagtatagatcacatgaggcgtgaggacgcaatcacttgttcccatatcttcctctaaaacctaaatcctaaaaaatcccttttcaaagatcaagttttaaggcaaaaaagcaatcatgattttggccagacacagcgaaaggaccttgtctgtttcgaaaaactcatttaatcatgtgttattaatttattattatcaacaatacaatcgtactgggtgaccaataatgagacgcacccatcaaattgggccctccacggctccaccactgagagggatacacgaaagtcgttttacaaaaacacctattaaaaataaatgtgcataaaaatctattaccacgtgtacggtgaagattaggttctcgattttgtataagaaggtcgaagtgtgaagaaatcaaaaacccaaaatcgtgaaagttcatttctcctccattgatctttctttactcagatctttcctcttcctctgag

SEQ ID NO: 4505 - DNA, 2000 bp, Arabidopsis thaliana
agattgttgtagtattagttgtgtgttttttaattcattttgcaaaattttcataggctcatagtgttcagaaggtcgatcatgagtcgtgataaaggaattgaaatttcaatttattaagtttattgtaaatattaaggttcatatatttccatttataatgtcattgatatgattccaatttttttacttcaaaccataatgctgcacaaattatttggaaattagcagaggtttttgttttgttttgtttaaaaggataaataattatctaattttgatctaatttaaaattagcaaaaataaattgggatgaaatcagtagaaatgtttttctactattttgttcaccagtcacacccaatttggattttatttcaaatttatttacttgtttctgaaatagttatcaaatattttttttatcaacaaaaaataatttttagttgtgacaaccaatgacattaacatatatgattcaacataaaaatgaagaaaaccagagaaagaataatcttaactttaaaatattaataaaatttctaaaatttaaatctaaaactttaccttgggcagtttgttttcaaatggaattaaaacgcaaaagcaatgccacataatttaggcatttcgagaagaaattcatctgaggaataattgtatcgatgtcttgtctcgaaacatttacataggttttggcgaatttgtgttgttgtcgcttgacggtccacatacttaaaaccttcacaacatgattgattaatagattgtggttgtaacgtgtggtaggcacgggtccaggtaatctaatgcttctttgcatgttatgctagatactggtttgacattataatgtgtttgagataaatgttttttataatgtgttacggatcgttgagataaatgatcgttattaagttagagacgttacaactcgactattcaatgatattattaagagagctaggctataaaggagaatgatgttgatcaagaaaatggacaacttttgacagcttagcatcaacaacatattagaccattcatttgtaatttcagttcacatctcatcaagaaaataagtactgtctctttgattcatatttcaatctctttctttgtccattctagttcggttttgtatctaataaacaaaagagttcactccaaaaaaaaaaaatcagggaattttaatagccgagatttaaccgttttgacattgttgtttttgaataaatcagaggtgacaaactagggtttcaataacgacttctaaaatgctagctgtgataaaagatgagttctatacttttattcttgctaggtcatgtgtactttatcacaaaaaatacttgttttgtttttttatgttaagtgggaagtcgatagatcgagttttttggggtcaaaaatcggatttatatcgaaatccggcaccaacaacaaaccttttgcttctatatacagtatagttctcttacaattcacaaatcctgctagctcagcgggggttctcctcaaacaaattgaccctataattcaaataacttcaaagttcctcaataattcttatgtaagatatttaagtatttaattaataaattattctgttgaaaaaacgggatatgatctataagtagaatgccttgtcaaagtagtgcaaggatcagaacttgccctttcaagcaaaacacggacaacataaatgtgtatacattattacatagcatatatgtcaacgtatatacatattatcacataataaattgatttcattgacacttggaattcaagttggtgccacgtaaacagtaataatgtttatatatggaaagacagctttataaaagatatctaagcagaggcttttcatattcaatgtatattataagatctgcgatccgattaacataaggttttatttttgtttataagaattattcttcgaagtcattctctttggtcactttggtgagaatctgatcggaaagagagattat

SEQ ID NO: 4506 - DNA, 2000 bp, Arabidopsis thaliana
ggggtaagtgcttttgttggggtggatttgcttgtgagagtttgctgcaattgttggattttgagctatatatggggtaaatgtaggattggtcaagactctttttctgtttctcaagtttattggtcttaatgattaaaagtttaatggtttgtttctggctatgtatcttttttttcttctcaagtggctttttcttttatgattggtactgttagaatttggagattgttgctaagtaacttaatcatttagcaaggtagcttaaatctaagatgattagggataaagaatattggattctgttctgagtttagagaatattggattctgttctgagtttagagaatattgaattcatgtatcaagcataatgaatgaaacttattttaagacaaaattgagtttgagattccattttaggaatagacaacaagtctacaaagtgctcacttatgtactaatataagaattcactaagttagtaaacctatcattaatcccgaaaatgttaagtagtttgatgaaaatcagaagtatgcgtaaaataataacaaagaatgagaaaatctgacacgtttaagcgcatttttggtaaatttaatctgaatattcatctcattcttttttaaagaacacttacactaattacattcccttttcttctccatttatcatgtattttatataatattctcatctaaaagatcattctcattaatagtatagattatttaaaagtgggtgttgaaacctacaaaataaaattaaaacacatttcaaaactttaaaatggatgtctcttacatatgtaacagaaatcacattgtccaactatctactatacttatgtgaaaaaaacatacatatgcccaaaattgttatcaaaccaaaatgttctggaaatagcccattggacatctatttataaaattgcatacactttagctaaaaaaaagtacttcagtttgttgttagaatattcaaattcaagaattatttttgaaagaattgtgtgcagaatatcaaagaaattttgaaataattcagaattgtgtacacaatatcaaaaaatccatttcgaaaatgctttgtacacttgtgttttggcttgtatttttattttaaaagtatgatatgtaaaataaataggaagtgtaggattattctttttcttgtctaataaaaaataaaaaataatcatatgcatttatgaagataattaaacttttaaatactttttaatatttcatacatattatccatttctcattccaaaaaaagagtttaattctcagtttcagaataaaatgtgggccttatacagatttagttggcccattaatgtacaggtgacaataatccaccaactcgtttctcctgacacaaaaaatatctcatcatgtcttcttcttcgtattcgtgtctctcatttccttttttgactcttctttccaaaaaggattagatctgactcactattacgtgtcacgcacagttcattaggtacgctcggaaaattttatccacacatctaaatatctgatttatgatcaaatcacccatttttatttttccttttgtagcttctcaaatcttttgtctttattcgatttaaaagttgatgtactctgcatctgattgttttgctcgtgttttattaccacgttgtggttgaaatttgacggcggaagttcatggtggggtatgaagccagttggattcagatttttttgccaagttgattgctttctagctgattcattgaaaataacgttcctttttaaaaacccatttgttatcattgtcttctcaaaacgtatgatctggtttttcaaaagtgagtctggttgagttctatgtgtttgtgaaaatgtctcaatgagtgaaattttgtttctttttatgtttttagtgtctttgtctttggttatatagatgttgatggcttgtgggtttggaaatattgtaggtgaaggcaagagattttatgaagaaag

SEQ ID NO: 4507 - DNA, 2000 bp, Arabidopsis thaliana
agtaattttgatccacatcagtatcactttcatatactgcaccatcaaacatcatattggccatgttttcatcatcactgctagtatctgaattgattgtagcttctgctcctatgatcacatcgaaaatttataaattaacacaacttatataaaatgatactttaagagaaatgtttgtaaacctatatattcttactcggattggtagcagatgttgatgctttctcaaattctgcttgtaaatttcgtatatgagaatactctgttgacatcactggtgtctgtgtttggttgcttatacatgaatatggattactcagttcttgtccttataatacataaaataagatttagattaatgattcggatatttaaaagataaaaattacataatagacagagtagtttggagaactaaaagatatatatagaataactaacctgtgttcactgtatatgcagtagctggtgtcatcgatgcatctaaattttgaggtgatgcctaaagatttggtttggtgagatcactaaatggaatagtagaagctgtcttaggctgatgcaaattttttctgccaatcgaggtaagtcctgatctttcaaatgaacctgcgagtagttcaaacacattctaagtaactgtgacaaccatttgctaatcttgtaaagcagatagaatctgaaagttggatattgtatagtaatgacagtaccatgtgaatactgtatagaagttgctgaatcaaattagtgatatctctgaaaactgtattgaaaactgatctaatagacacataaccattagaattagatccattacgctgagtaagttggctttgtgaagctgttatttgacctatacgtggtctcttctctgagggtggaggtgaaattagatcaaacagagcatggctgtttttttttcccatttcaatactctagactgtcatgagtattgagtgatttaagataactggtataagattttatagaattgttgaaagtaaatgtaatagagtccatacttgattagagaggatctgtttgttagttaaggaaatatttggtaggtgagtaaatatatcaacttgctctgttctcgcattttctacataaagtatatttactttgctacacaatatactagacgattacaaattatgtaaccaatttggagtaccaaatcgaagttggtaatatattttttcctttctcaactgtcatatattttggatttaatgattctccaagaaccaatattctgctaatgttctgaatctgttacaggtataattatttttgtaaattagtgacaatatcatatatgttaaaacgaaattaaaatttaagaattgaatactttaaagaacacaatatcataaaagttataagataggaatagatatgtttcaatccaaaaacataacataatgttaaaaagtactaaaaacataacaactagttcggagtaaaccgaagaaaccgaactgattaacccgaaaatttcgggtttcggcgtaaaccgaagagagaagtctaaactgatcggttgaattaatttgttgcaacggtactcggttcgggtcggttcggtaatcggaccgatcggtttattactctaaacctaagtccattaataggagccatatataagtgtaaacctaactaagttaccctaatttgtttatcttcttcgcttcggctccgcctcttattctcgagaaagctcatcttgcttctcacatctaaacaaatatctcatctcttctattctactttatcacttcatctccgtacgctcttctttcttcgttgcttcttcttttgatttataaattggatccaaaacatcataggctctcgtcatccttacatacaagcattgttactttgtgatataaagaacgaagaattgtacgaaggcaacgagcaagatgagtagcaaggcgaatgaggtttaaaagagtagcaaggcgaatgaagttgaaaggaggaag

SEQ ID NO: 4508 - DNA, 1449 bp, Arabidopsis thaliana
ttacatttatatttgtattcttcagcctcgctgagtgataatatatcattctgaaaggtttcaaatacaaaattactgtttaccaagagactatggaaggctcttctcatcctcactccttcctttctttgagtatcgcacaactaatgtgttactctgatcaaactcatggaaaactatctcctctaaaaactttagtttgagtgtttttcttgagttcaactacttgtgggtgttgggattattagtttcgagaagttactgtataatttttgaatttttatcattttaactctcagtaacaaattactttaaacttttgaatcttatgacttaaccttttaattttattctcagtgattggcctgatttttccaccatttattttatgaattcaaatgcctttatttaccgtattccgtattttagatattattgttttaattttaggcttaataatgtttaaattgtatatttgttgtactgagaaacaacttgatttttatgttttgagatatatagtacggctactttaatttaaaaataaccattaaaccactagattgattttttaccctataaaaaatgatgaatcccgaccccgataatctggtttgctacaattattattttcttacaaccaaagaactaattccaaaagaaaactaatctccagatatactttatattgtggacgccttgattgactgtatatgtgtttcactattacatgttgatagattacatatatgaaagagaagtagagaatcgtatatgtacgtaagactaaccaacaactcttttattttgtaagttggtttcgtggttgagagatatcaaattaaggtgcagagaggttggtcacttttaggtataggatggaaatgtcttaccacatgttaaatatgaaaagaattgctaaataattataacgagttgcttctaaatattagtatttgtttatttatgatggctccactcttttcctacgctccctttgagtccacacgcatctaaagatattcgaaccttggaagagccaaaatgaaccttggagtaatatgtatttttatctacgttgtaaatatataaatgaataataagaataaattttgaatacatcatatactttacagtgtacgcatcatataaaaatttcttatttatgaacaatttgaattgtataacggaaagaacaagtaattaatcaacaattctaatggtgtattatgacttttatgagtctgacatttgaatttgattgcacttgttacttgtgtgttaatgtgtgttgtgcagcaaaagggtccacacgtaattagtccaaagataagggtattaaagtaatttatatatgtagctaattacaaggtttaaatacctaacccaattccttgttcatcatcttctaacaaacaccaaaaaaacagagaaaacaaactttaaaca

SEQ ID NO: 4509 - DNA, 1856 bp, Arabidopsis thaliana
caaatctgaatcgttatagctcctagacaacaattttgattgagagagatagaaatttagtaattcatatttagagaaagtttagcttttagttgtcagttttccggagactgtgggaaaatgtgagtagcgtagaagctaagtattgcgtgacgtctccgaggaagaaaacgacggacaggtaatgataggaaacgtgaaccgcaaggtatcgaaccttttttcttttttgggcttttgtatcgatacgtcgtcgtagaggtcatatttttttttgtcttttacccaacaacactaattagagaattttatataatctctatgattagcttttctataattttgtaaaatcttcatataatcttgtaaaatctgtctaaatataattacaaactttgtcattaattatttttatctcttagagggtgattgacatcgcactgtcaagactttaaaagcatttgacagtccttacagcattttttcatacaatcagactgttatttgtttttgctcttatacagtcttaaaagtcagatttttttttactctctgtaacttcatttttatctaaagccatgtaattgagactttaagtggtgttaaagcttttgcaacaattattattagaacatatctctaaaatattggataatattttctcatcttctataaatactattttcaccaaaatgatattattattttaggctttctttataaaaaacgtaagtattgattgtcaaaaagtgtactctcccaaaatattccactacgattttgttaatacgtaagttttcaaattttcctaattcatcttcttaatttgtgtgttcatatactattgtcttctttgtgtttgagtgttttggttttgtatattttttttttatgattaaaattctagtgattatcaattttttttcttattactatctatacatatatgcttagtttatggggaattcccaaaagagtaaggaaaaaggtcaatacaaactgtgtcgtgaggttttgaggcttgtgataatctatggtcattcttcacgatggtttatcattggtctttgtttatatacaaagttatgattcacaatcgctcactttttatgatattttcatgattttgttttgtgaataaaagtgtataaaattataaaccaataatacaataatttaaatcattaacaatcatagattcttttgtttttagttgaatatcacaaaaaaattgatgactttattaaattatgaatccaataacttcagatttattaagactttagattactttttacaaatcaaaatttaataacactaaactttaatagaatcttataaaatcttaattgaataacaaaagatttttcataacatttcaaaccactaaaaatctatataaataacaaaccaataacacctccttaattttggttttgaaacctaagttactaaatccttaattacatttgtataaattcttttcaaattattagatttattctaaattaaaattagatattctgtgtaaattatttattataccaacgcaaagaagattagacgaagaggcatggagttgtaatgttgtatcatgcaaataaggtaaatactatatatatatttaggggattatatagttgtctttcttttgaacatctatttaaggggattttctaaattctaatataacgaatgtttgtactacacaaaaaaatttaacaagtcaaaagatgatgtacttgtactacagtacaacacatacatttaagaaatcacaataaatacgaaccgattctctcttaaaaattttgtctacaagaaaatcaatcataaaccctattaacattagtatc

SEQ ID NO: 4510 - DNA, 861 bp, Arabidopsis thaliana
tgtatctggagcgagaacaacgaagaagacgaacttgagctgagaatgaagaaatcagatcgaaaacaatggagttttgagcttggaaggctttgataccatattagcggaatagagatgagagaaaagtttgttgaagatattatgaaggcttttctcattaattgtaaaatgattctgtacaaatgtcttatatactttacactatacaatggttctactaaaccaacttatatcaactaaaccaatatacatatctgatatgaataaatcgatgacataacaacgatttttgtttttgggtaactctttcaaaacactgcataaacaaaaaaaaaactattatatgcattaagtagtccaaaaaaatacgtataaaacatatcattgtgaaacatgattagattttttaggtgttaagtagtgaataacataaactttgaataataaaatttgaattactcaaaaaaaattcaatagataaatcaaaatacattattcttgaaaaccataataatcaaaaaatgaaaatatatgtaatttcaatctcctttaataaatttcagatgacaataaaaaataagtcactaaattcagttcattttacaacaaagataactctcattttggtgcaacaatatgaaaactagctctcaagaaattgaacaaaaacttttacggcccaataacgacccaaatcaaaacccactaagagttttgttgattccatcagagtttcagactttcagagatcagaaacctcttcttcttcttcaatttcacagcttcacgtcgtcgtctttgagtcgccggagctgtagctactgatttggtaccagaaagagagtgcgacggtggacg

SEQ ID NO: 4511 - DNA, 874 bp, Arabidopsis thaliana
ccctgtatatgctgaatgaactttgtcattttctgttaaattaatttcgctgatgccatctatgctttgatgatgacgcagttagaaaacagcaacctaagcaaagaaatcccagtattcaatcgtcttgtaagttcttaacatcttctatcgatttggggattatttaatttgtcatttcaagactgattttctctccaagccctcacttattttgtcttgtgtacagttgaaggaggctgctagcttcctaacatccggattgatatccccaggaaatgaaccgatgtatgaattacatagtcatgtatcttaggattgtaaacatctccaggtttatatttccagacttctcaattattaaagcttttcacctctagttcaagattccaacatcggagatcgagtttcaaggagcttcagtacatacgtgatggggacagcaatggggtgctgcactttgtgggtacatcttatggtagtcatcagtgggtcaaccccgttctcgcaaaggttaacctcacttttatcttactttctttattcatattgttggaaatccaattaccatgacaaggaattctgctggagaaaaatatttccttatttgagttctttatgttttacagaaaatcaacattacatcgagtagtcccacatccagattcactgatccaaaggctttggcttcaaaagcctatgcggtatggtccacccaagttcgctcggattatatgactagaatttggcttgaactacaaaattgacgaagcataaaattaattgaagtgaaccttctttcctcttagatacagtatttaaccatatgatttcatttttttggcaccagggtacttcctttgcagggcctagg

SEQ ID NO: 4512 - DNA, 2000 bp, Arabidopsis thaliana
ttttgttgtctgtgtttccttttgaacctcattctgaaatcctaaaagatttttatgataaacctttctctcttctcgaaaagcttatgttattcacattgcatactctcaatacgcaaagttttcattttgtacatatgaaaattatgtaagaacaacgtaaccaattctcgtgatcgttaaagtggtagttgaattgcagattttcatcgaaacagcagcccgccgcattgctatcacaaagaatcaagtctttggtgttagtcgaattgaagcaatctgaagtacctaaaaaaaaattacaaggaatcttaaaaacgaatcttgcagcaaaccttcaaaatgacacagaggactcaaagacatttatgtgcgtaatacaagtctgattctatagttgattagctgagttttggtaatgtgtaatatttgtgtttatgtgattgagatttacctaaattgtctttgtccatcaatttttagcgtttgagactttgaggaattggttttagtatctgatccaatagctagatttgtgttgctcttgctctataattgtcttccaggttgaatatggtccaaggataattggttatcgtcggctcttagatgtattctgctctagtcatgattctagacaagtgtttggacaaggtcctgatgtgggtaaccaatacaggtaaaagagctgtttggttatctttgagtttgtttgtttggcccaaatctataacatttgaatatatgttgaacagatcctgtattttcactaactgtacagaagagttgagactggcttctaccagcaaagaaagggagcaacttaatacaagaagcagtatcgtgacttctctcttgtcgttgactcctctcttcacgagtctcatctccgacgcttcttctcttttcttctgttgctttggttctcatcttcatcacacttattgcaagtttgatcaaaggctcaaaatccaacaaaattcaccattttagacaccttgggaagcacgttagccggaaaaccttgaaaaacccacaagggttttcaatgcgcctcctttggataattggatcatacatacaccattattggataatactctcttgagtcatgaagattaacagaaaacaacatatcatcaataacacaagacggctcttgcctcagatcactcaacttatctatttctctccttgacttcaaattagtttccctgggttggtaagcataagaacagaaccgtgcttatccctcatgtcaaattttctcttccatcaccacatatgtcacaaactctcagtcgcagaggtgcgtaggttcggacagaaggtcttattgctgctaggaggagaggtcaagctgctgcttcagccgccactagggttgttaaacaataaataaattaaaaaaaaacatttgcttctcttttatatgtatatatatccgtttggaccttgttctcaaattgtaaacatttttatgataatctttgtcttctctctcgaaaagtttaaagtattattgcaaattgtaaaaagttatcatcgcaagttttgattattgttctcgaccgaataattttaatatttaaacgaaccgtatcaaaccgagtatttggttatatgtttaaaacgtctttaagtatcaactaagtagaaatatggtcaccaattgctaactggtaaaagcggttgagactcagcatgatgagagagtctcaccacggttcgagtcgcgatattggtacctcgctcctaccaaaaggaatcatgccttaattgttagccgaaataaagtaatctaaatcacttctttttcaataatcatgcagcgaaccctctaaatgaatcagagggtctcaactctcaaagacagagtttaatggaggtggagccatggcgtgactttttgagcgactcgactcaatcgactacaggttgttcgttcatatggagtttcgttccctggttcgaaacagcagctagacgaaaactgtgta

SEQ ID NO: 4513 - DNA, 2000 bp, Arabidopsis thaliana
aaaaagagtagcaaagaaacagtttaccaaactatatatatatttaaactaattggcagtgaatataaaaccaaaattaaaaatttaaaaacatacattgacaaacaaagatatgatatgtctccacacgaacatatttttacaataaaagatttccaagaatcatgaactcataagagaactttttaaaaagaaaattaactaattaatataaaaaaatcttcacatcttggtaccggtgcgatctaaaaaaaataccaattgactaataaacatgtcttcgtataaacccaaaaacatgtcttgtcaattgtcataactcataaccggtctgagagagtcgttgtgtctaggccgatggtgattaatatctggtatcttacatgttatctatctctgtttttacacaaatccgacggatcagttcagagattcgatgagttttggtatagaagaagagaaactctagatttgttgaaaattctcaacatgataatccaaaacgtaacaggctcaataagataagcgggcctgaaaattaaaacaagcccaaagaacagaatcagaaactggtgggcgttagtgaaggaccactcctgcttgctcttggccttggctgcttagtgaagggaagggagagaattgccagagcagacgctaagcccaaagaaagtgtcaacatctgagttgtgcgacttgtgagacactaactgagaaaaaaactaattgtttatttatgttgaaaacagaaaaaaaaaactattctaattgaatattgtaagaataccgtgtgcgtaaacataaatgttatctaaagagattactactagtggttcctcgacatgcacacaattactttagtttaaagcttagcttttaacccaactcggcactactataaggtatggtgagagatcaatctcaagaaacaagaatattcgaagtctgggaactataatgagacaaaacaatctttaaaatactcgatcgcatgtgttgtgatcacgagctcactacgactcagtcactttgttctttctttaatttagtaaaaaagtcgagttactttgttttctccgtcttaaggcattagccatataaatcgcatcattgtccggatcaactcttgagtttaaaaacccacatagacataaatttggttcgtagtggaatcaatccgaatatatgttgtgattttacgcagaaaatgggaatttacattcgtcaaaatttgagttatgttggatttttacatgaataatactattgtgcaataacatatactacaactgaacataaattttaatttttgtgtcaaagcatataccatcaacgccgttggttttacttttgttgtaacgacgtcgttggctggttaatgaatatgaagcttttccgtaattataccatcaacgccgttggttttacttttgttgaaataatccaatcatattactagaaaaaaacaaaattgccacatgggtgtgttttcactttttactttttactttttacagttgaattttatattaaggaaaaagtcgaaatgaaatagtaaatcgaaaacaaaatcagagttaaaagagtaaattcaggtgagagaaatcagcttcaagcttaagagagcttcgaaagcgaaagcgacgatttcttctccatcgtgagagcaaatctccagagccgttttctcttcttcttcttcctcctcgcgccgtctctgaaactccatcatcgtatcaatcaaattgcttcctcctccaaagtaagcttcttttcgattctcaaccaatcatagtagtagtgtgcttctctcttatcctctgttttctaagttttgtatcaatctccacatagcttttctcgttctattatcgtagaaactcttaaactatagattagatcactcacgattcaatcataatcaatctggatctgaatctaattacgcatcgtgattcaaaatttgtgtttttttgtgtgtgtgtgacagttgaaaaaca

SEQ ID NO: 4514 - DNA, 2000 bp, Arabidopsis thaliana
agacttttgtcctaaagttaaacaagtacagaagaagtacttgaaatcttcactcagacgattagagcttagagcatacgaagattagccttagttacttgcagtatgaattcaacattttgagacatggatctctgtaaaattgaccaatatagtggttttattatggtaccttatgagaaaagattagcctggatagccacaaattcattgatattggaggacttggctaaatttgggcgctattagtctattactaatgctagtgaatttattgtgtcatgaactttgatattattagcagttttaagagccctcaggacaataacatttggtaatgaatgtaataacatcccttacatattagtgttataacactatctagtttactctcaatttggatgtgagagaccaataatcataattcataacaactgattttgagaagggttctgttttgttttccaaagaatgacacatagctaattatatatgcaagtttatgattctctgatagattcttcttgttatgattatccgttcacattgaagggctttgtcataatttgatttttctttagtttgaatatatcgtaagtcctaaacatgcatgtcttattaaacaatgtgggctctgctctgaagactattgcctacatttatgctatctactcaatcccttaggagttatggcatttagtttccagctgatgatatgtagaacattcataagcgagctcaagattctacaatacgtgtataaaagatgaagcctaagctactactaggctgcatcggtcaaaacacacaagccttgtctttttgtttctttttcttacaaaaactttgtctcctacagtgacttcaccaccaacaccatcactgacaaacactaataatgaaagaccaaattcgtatcacagaaagataagactgaaaaatcaaaatgtttcaatagcattagcctccagaagaaataacaacagtcgttgtacttgtatcctagctaaaagcaaaatgtaattgatttattgcgaattaaactctatcttgttacaaactttaacaaaagttttaatattttgaattccgtacatgtaaatggaagcatattaattgggaaaacaaaagaaacatagtggataagattgtttacaagtcaacacacaccaatttagaaaaatcaaagaaatcccgatttgatgcgaacatgacgacgcaaccatatctctccaaatcaaaagattatgtgtgtcacattccccactaatttcacttatatctagcataagatgccatataatatacatgtagtatgtaacgttttgagaatgttcttattcggcgagattatttttctgacaatacatagcacaatgtttagttttcccaaactatataattggaaaattttccaatgacatctcaaatatgtcgacatatccaaccgtaattccgtaaataggaacaaaaacatccaaagaatttaagtctagttgatctcaaattttaggcaagttgcaaataaacacaagtatattttagttgaattatacaactaaactcaaaagtacatgttgttccagaaattaaacagatagacagttagttggtaaagatttaattagttgattcaaaaaagaaaaaaatttctcgagttatcttaaagtatgtttgtcttaacttatcaaaattatatctaaaacccacttaaaggcttaaaccatgattattgtgtcttgtctttttttgtaattaaattacttaatcagctccaccgtaatcagctggacctccactgaatcttacccaaacatatcgatcacgtgcctgtgtataaataaatacatacacacttaacaagttacaatcagactgacaccaatcttcctctttaacagtcgttttattacagcgttctgatcaaaactccagtgaaagttcaaagtacacagagagaaacaaaaaaagaagaagaagaagttgaagaagaagaagcc

SEQ ID NO: 4515 - DNA, 221 bp, Arabidopsis thaliana
aactgttttttgtatcatcaataaactccctctgaaatattattgcgtttaaggtaataacaccaactgtttgtaataacaacagaattactgcacattaatttaccaaagtaatagtgatccccagattaaccgatttattttttaattaaaaatgataaaatttaaaggttgttgaaaggtcagaaataaaaagccgcaaaaactgaagaagcaagata

SEQ ID NO: 4516 - DNA, 2000 bp, Arabidopsis thaliana
catttttctatattctatagttttatgatattgtttggcaatgatgtgaaaactcagtatgattttctgaaataatttagaccacttatttgttattacaacttttttgattggcatgaaacaggagacaaaaatagcaaaaaattagaaatatcaaacattacttgttcctttatatgaacaatgaggatgaaaatagctttggtgcttgaaaacaatacctttgagtttggaccactcatattcattagtcatttccaataaatatcagtagttgccctcatagacaaacattaaatttcttttatttgtggttcctcagatttaattctagcttaagtactgtggacagctgttttaatttgtcaaatgtgtataccaatcaaattaaatttctgaatttgatcaacaaaagaaaaccactctaaccacaaccactaatgcgtgtgcatgcacacaatatattaatatatgattctataaaataaattattttaccttattggttcttaagattaaactgaatatctacatgtatatctcagtggttccgttttttttaaagtaaaacatacaaatattacgtatataattcagctttactttggttcatattctttttttctttgggttcgtattctttctcatacaaaagtttacatcaacaattatatcatttaataggattagaaagaaaacaaataaagtagacctataggtatggttgcacatattgattagtgattaatatagttttgtagtattttgcaatgaaacatcttaattgactcccatcattaattagtgaccaaccaaaagaaattgaccttttgatttagaagaaagagaaggaaagcgtgtgtgtggttacttgcttgcaactttgctaacgcaatcaaatcttttaacccatacactatactcatacttttcttcgttgcatctattctcatttcatttcacacaataatatggagtacaatattattttaatcacatcgatcatagattcatgataatattgccaaacaaaatgtaagcttaaaaacttttaatgttaaaatgtccaaagaaaagctcgacgtgagtcaaagcaagttgtttttattccaaaaccatggtccagttacgaccccataataggatacatacaaacttgaaaagttataaaaaaattcaagaaaaaaagatattcacaagacatattctcttcatatttcaaccaaattcgagaatttgaagtcgaacaattccacacgtaatatccctctagacctctggtttcttctttccttcctataggtctcgccgtagtgatctaagctttatgaaaacatttgaatttcgagattcgtgtaaatacataaataaataacaaaagatgcaaccaattatatagcaaacgatattattaataaagattattaaattataacacaccaagaaaaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagaca

SEQ ID NO: 4517 - DNA, 1003 bp, Arabidopsis thaliana
ttagctaacctaacaaaaaaaaaaactgtatttggattcttcttttattgagatgttgatgctattaatccctgaacatgatgggaatgtttgtgtaaattgctcaccctggtacatgcttttgtttatataaaacctagagtgtgtttttacaatgagaaatttcatcatctgcttaatggtttggattagttgtacaaatgttaattctccagatgtgtctctggtagtagttccaccaaattttccaggtccagaaaggaatacactggagtaaaaggtatattctttccaaggagaagaatgtttatagtactcttggtggattgttgcagttgtcaacttgggagagaggatgatatggtgaagtctcctccctctctcccatgtcttgttcattgcaaagtcttgttctttcatgtttcttttcatatacacttgttaatgaataaagttgaaaaaattcgtgaggaaaagtccgaatctatcttctctgcaaaaataaaattaagtaaaagaaacataaagttatggtttaaagatgctttcggaaactccatcattttagtgggagaatcacataaaagattggtcgtcaattatttttcttttattaataaggatgcacatgatgatgaatattaaccgtaatatactaatatagatgacaatgtatttcagtgctaaattatagtaacaattaattgaatgcttaaatgaatcttttattatatactactttatatgtgttttttttgttttaattgagacaatgatgatgcacctagacaagaacgtcctactctctgtgcatgtgcttctcattttatttactcttttaccaaacaaactgttcaacttaatacataatgttggtagcccacaatgtgaaagattaaattaaaactcatccattacctcctgtaagctctatattaaccactttagctcttctgcacacactcacaacaaccaatcatatttattattaaaaaaaagagtc

SEQ ID NO: 4518 - DNA, 2000 bp, Arabidopsis thaliana
taatatgatatcattgttacatgcatatgcgtaatttttttcatagttaatatattctttgtaatatggagccgactgatgaatattggtgagttctagtgtgtgacaaagatgccattgttgactagcaaattctaaatctgaggagaataaaataattctagaaattgaacttttgtttttaacaccaaaatcaaaaccaatgggcccaattctttgctgacttggccaaatgagagccgtccatatgtcagtcgacaactgccaaacaatcttgacggtttgttagtttggctcaaaagccaccagtaatcactgatcagtttgggacttgagtaaatgacttatttacccttagttcaataatacggttttgtgtgatttaatttgctagttaagttaaaccatatttaaggatggtttaattacatttcaggtggaaaaaattgatgagagaatctagctagaaaaagatggacacgtatggaccgttgaaagtaggaatacaaattatttaaggaatacaatatttaatttcaacaccaagtgtcgaatagatacaacaataataatgatgaacaccaagatttattttatattctctattttgaatattgattactccaactttttcatgatttgtttttcagcacttgagattggaatagacacactgtgatatcgaccataaaatattttcttaggaatatatcgttgtgtataaagtataaagttaagtgtaatgctttaaacaagaaaaataaaagagttgagattgtaatcatagcaaaaggctattttatagaccttttagcggatggaaaaaaaaaaaaaaaaacaccttttagctacatgatgtagcctacatcatatataaaaaagataatagaattatttaagaaatgtaatgtgttataaattaataaccaacacatacacaataagattcatataagtttatgaaatcaaggttgtgatattgttgttattgagatccaaaacttaaaatccaaaatatcagaacttttggagcattggattatataaaatatatttttctcaatcaaatctttttttagttaacaactttaaattaatcgcaatagaattattcatgaaaaatgttatttacatataacccaatccaatgatttcaaaagagatattatagaattttgtaaagcattaaagatttaactacattttgttacatagacccataatcataaaacctttgattcatagtttcattcttataatggtctcttaagtatgaaggtgttgtagcggagactagaaatatatatgagggtaatgtttgtctgttgagacacatttttacaagctattaaaaaaaatgattccaacaatatttattgaaagtaaatgtattttattaggagattttaaaattaatgtcatattctaaaatgtacaatatatacattattttttgaagattttacaataaatttcaaagtgaaactgaaatgattttattaaatttatatacataactctttgtgtttttttgacagtcatatatataactcttaaacacaagcttttacagaacatctacagttattttaggtgaataaacactccaatttcaaacaatttaaataaataaatgataattatctgtcaacccataaactttacattgtaagaccattttattttatttattttgactatttatggatatgtgatattattgagaaaaaaaacactattactaattgacagaaaaaatacacttaatattttctcctaaattttctcaacgaattaattacaaaataatgtgtataccaagtaaaaagattctacttctcagtgacagcagaactaatttattcaagggtagtttcggaataataaaaaagcaataaatctctttttcctataaaagcaaagagacactcaccaaacaactcgtccctgaaacctctcttcagaaaactcaggcaccattttctccttccgccgccgcc

SEQ ID NO: 4519 - DNA, 2000 bp, Arabidopsis thaliana
ggactcgaactaaaaaaagtttatgttctttccaaaaatcatttgatgtataaccttatagatagtaaattagcaattgatgataattaattaacaacaatgaacaaacgatctttagagtaacaaaaatagcaatatgataagaagtaaatttaacgtaaaccttaaacagtggttaaattatgaattaatttatccaaatacttattagttatcccgtcgctctagttgatgataagtaaatatatttaaatcttcccactgagcttttagtatttgtatttttttttatcccattaactattttatggtcaaccagcgtcgtcgtgtcgccattttgtgaatcaaactaatttatttaagtagctttggtcaaccgaaactttcctaatgaccttcgttacgtcctctatccgcaaattgcattgcatgggcgtcagtttttttttccttttttcttaataacgcgtcaatttattttatgatgatgattatgtttagttgaaataatcttcagttattaattagatatttcttggtaaatattttttacaaatatgctgtcagaaattcaaagttatgtatttccataccatattggactccatactttatatcttctcagttgagtatccttcaaattcacctgttttggaaattggaaatataatttagttttagaaatgttttaagttaaaacataacagttaacaaagaaaagatatagacaattttaagacttttaaatgtgagggattctcactttttcgttgttttctaatggttccaattcatagttatcgtataatattatttaacgaaacattagtcaaataaataatctatctattcgccgactgtatggctgaaaatattagctggagctagactcgtattgaaaaaattaatccatatatttgttgcctaggagagtgacattttgacctttttaataacataccaaaaaggccgtttatttaatatattatccagatagcagcgttgaatcggattttggttggttttggtttatgtgttttagatttttggttaaagcaaaccactaacttaagtcaggtcaaagtatttcagcaaaactaattctcaaataatcacttttactccgcaaaactgcttgtcaaaatatagttttgacttccaacgagccattttttgctaattcagtttaactagtatacgcaaaaaaaaaaaatgtttagataaattaaaatttcggttaacttttataaaaaagtttcagtctgtctgtttgattcggtttactttaactaaatgccactatcttaaaagatgaagtaaacatttataataattcggtatggtcggtacaatcagtctagtaaaaccgaattgagaaaaccaggtcggttcgaatatatccaaaaaccgaaaacacgtgtgagaaagaagaaatcagggaattaaatctgacagtctttatagttttctttaatatgtcttccccaaaaaatcaaattatgaataaaaaaagtggatcgcaagttgcagtttggttctttacgggcaacgaaggctgttaaataacagccatagcttttcttcgaaacgaacccaaaaaataatatcagagaattttcatcattacacctttttttttcttttgcctttgcctttgccttcacacgtcttcttgtttgtactctccactttttttttctttgtgtcctttcttcttgttcttgctctagttcgtgtctcttctttaactctctgtcactattataaatatcaaactctgacattttcttctgttcaaattctcctcgaaactcccccaaagaaacaaaatctttttctgagatctaagaagatgaaaacaagacgtgggaaacgtcctgaggtacacaagattaagattctctctcttttttattcttgtttctttaattctctgattacaaagattctgatgttttctcgtctttgatgtaaaacagaggttttggccatcaattgtg

SEQ ID NO: 4520 - DNA, 443 bp, Arabidopsis thaliana
ataatcaacattgtaatgtttcctttttttctgaatgtttcagttgatattaaaagatagaagaaccaagccatttccattattgtctttcactaatgacttcttttacttaaccctgtaataggctctgttttagtgcgcttaatcactattaggcccatataataattttcttgtgtttttgttttcccaacagtaagtgagaaaaagagaaactcaaaagttttctcaactaacaacggaagaatagggctttgcttgtttgagtgaatctcttaaacagtgtctcctcattttaagtagggaagttacatcaatgtctatcttcttacacgcctaactttgttctgtaactcttttctttttgtgtcctaaaaactctttataaacactaatctacactcccttaatctctcatctatccactcacacacacacaaacc

SEQ ID NO: 4521 - DNA, 2000 bp, Arabidopsis thaliana
ctctggacacgtgtcagcgagaaagcggctaatatcagcattgcctcgagatgatataaacgacaccgttcgataccgatccaatggaatttgagggataagtttttggcaacttgactttctaatttctataatttagatatcatccaaaagtgcaagtctctatccaatttttatgggctcgcaaacgcatctttccaatgtagataattgttatctatatcaaacaaaggccatatacaaatatcgaatgataaaaagggtaacaaagctttgaccctaacaataaaaaaaaaatagaaagaggaaaggtaataaagcaaaactaacgagataaggtgaagaagtgtggtgaatatactaaagttttggaacgaacaaagcaaatagccaaatacaaagtatacaacgtaataatgattaaattaaagtgattaaattcggttaactaattatatctatcattcttaagatgatcaaaataactctgtaaaacttacttaattaaatgtgttgctcaacagtttgcttcaaattcaatagttccttttcccatatatatatatatatataaggataaagattgaaaattacacacaagataaacataaatgaacaagttgattttgtattcgagttgtgtggtcatagttcttgtggataaattaatttagtgtcgcaatacattccccttttcttgacaattataggagcgttttagccaatcatattactaagtgtttgctttcagaaacaaataaaatagtggatttggaaatatattgtggttagtaatttagtatacaaaacagaaacaagcggtacagaacaaacaaaattaaagctatatatggtgtcatggtgatcggtgacaatgatttgtggctaattataaagatcatcattcaatgtagtttcccaaaataaaaagaaattagattcgatgaagtgttttaacactgagtgattgaaaaaaataaaaaaggaattttaataaaattgtagttggttgatgaaattgatgtgcatgtttttacaacaaagaaaaaaaagttgaattaaaaataaataaactaaaacaaaccacaatcgaaatgcgttgagacgttcgcatgttcagaaattcagaattttctttcatgcatgtttgccgcttggtttgaatctcgagagatccacgtgaatttgacattcgcaaatcacatttttcatcatccaacttcaaagtcttcactaattatccagcagtgaaaaccaaagtccattgccctcttattgatcataaagcccacacgtaaattgcaatctccttcaaataaaaccatttagtagcttcacaaccaaacattgcattgccatcactatggaactcaatttccaacgtggttttagattgagcatgacctgccaaaattttcgaaaattttctaattgcaacaacgaatacagaagaaacaaaaaagccaaaatgaccgaatctataacaaaaaaaaaaaaactacgacaatctaagcataagagattagcatccatcctaagtccgaggaaaaaacaccaattccgaaccgcgaaactcggacatttgcatgattgcctcaactctaaaaaactcgaataccatcgtagttacatatgataattgaatctaaactttctttcaaatgcatattgaatctaaagatgattcattgcaaaaaaaatataatcatatgtgattcatatttcatatttcatatttcatatttcgtaagcataccatttaaaaggtttaggtttgctaaaacgacagcgtttcaattacttgaatgttataacttagaaggaaaaagaattccaaagaaagtacaacagacaaaagaagagatcacaatcatctgccatgaaagttcaaaggttccagagcggaagcgcagccacgaattgactcaccaacaacactctctcttctctttctctctcttcattattattcaaaaagattccaaatttttcaatttcac

SEQ ID NO: 4522 - DNA, 2000 bp, Arabidopsis thaliana
gaccatcattccaattccaaaatttgactataacacattattctgaaccacagagaacagtttatattattaatttcacttagttatatataaaataatatatccgaagaagcaagaacaaataacgagatgtcaccgggcaagaagggactcaacgagtttaagccatcaccaatagaaattgtcggattcttgtaggacccatttaaaggtacgtggcgtctcctggctcgaaaatacgatgcgtggctgctccagtttagcccacgtcattcccctgccactcccttctcttgctattcctacactttcgttttgttccgtggactctcagcgctaaggccacgtctattggtcacatatatttattcatatcatattagtttatcactgaatttctatgaacactgtatatttggacgttgattataacgtaacctaaggacatgagattttgcgtagtgatagtattcatgatcgaccggaagagttaatactgtttctcgcaaatatattactcacatttaaaccgatcagtgacattcatcaaaacaatcaaatcatttgaatacaactacttgacattattccttctatcttaattactaagatatgccaattctatcctcagtagattgggtaaattgtctttacataagaaattagaaagataaagtagtagtagctagtccttacgcaacttggtaaaccaaaaccggaataaaatctacttgcaaagaagaagtaaaaccatggtcgccaacaaatatgcttactctatttagcttaagtcatgaatcatgatcactcctttttattctttatcaccaatcaaattcattgtattttaggatgtataatgttgacatcaacgtaagcaaactctggcttttttccatgagtccgactggtatattttaataaatgtgtgattaacaaaccttttgcttgtctactaaccaaacaaatagtggcaacaagtaaattagatcaaatataaacactgtgaacaatatgagccgttgatcataaattaggcgtaagaaatagatacgtacagtagaaaataaacataaatgtatatacacacccaaaaataaaggaataaataaccaatgaattaaaagtacattaaaggattccgacagcttcttggccaatcaatatcacagatttaaaagtgacaagaaagttcataaatttccattatacaaaaatgggaacgagtattgcatttaaaattgtaacctaggcataaagggcagcaatagttttttttttgtaaatcggggaattcaattttaacttaaattcgtaaacccaccacgccaaccccaagagcattatatcaatttattcactcattaatttatctgttcgtaaaacaaaatgtataataacaatactcacaaaccaaaatgtcttcataatgaactcataacttgtagagtaggcgaattacatgtcttgtaaattagtatatagtttttttttgtcttattttaacaactactatatgttatattcctgaaattttgtatacttttatcatgcaaatcaccttttttaaaaaaacgtaaaagaaaaagagggaaaatggtaacaacaaattcgaaataaataaataaaaggtgagtccctgacatggtaattatagctaataataaagggttaaaatatctacgcaaacacaaaagctgtcttcttccccacccacttctacagcctgtcatcactcctattggttcataaaacgacaaaatcctacgtggcatccattttttttcttctcttcttctgcaaattctctctatttatacacaaaccttccatttctcttcccataatttattcatttcaccggaaaaactgagtcaactcagagcgagttaccattaccaagaatcatttaacactactgaatacatatgggtatatgcagctcgagcgagtcgactcaagtcgcgacggcgaagctgatcttacaagatgggaggatg

SEQ ID NO: 4523 - DNA, 1591 bp, Arabidopsis thaliana
tttcttctccttctagtgaatcaaacaaacctgaaacataaaaatcattataagacctaaaacacacacgaaatgatcaaaggtattgaaggaaaacttcaaaattgatgaagaagagaggtcaagcttacctttgaaatgattaccagtcaaaatagttttggaggggttttaattgcagatttagaaaaaaatttctctgttttcttaaaaacatgatgtcggtgtggtagagaggggatggttttatgtacggatcggatcgtgcggggaagacaaaatagaaaaacaacgagggagttagttgcttacatgttgtttttcaaagatattattttcttcttattacatacacttttgaatttgttgatcgtgttacttacataaaattgcaggttaggtccctttgttttcgcagtttttgcaattatttctcatatttcttaatattgggcttttcacatgtaataagcccaacgataagaccatgacaatttctatacgaaacatgatataaattctttggatatacattatgaatttacgatatacaattagtttgtttaaatatcaaaatataaatgcgtcaatggttgttgttacttgtgagattatctttctatttaagaagaataattctcttcgtagataaatttttaaaataattttccgagttttctaatgtttctagatatgatttgatttgaacaattaattcgtggttctttgaatgaatatatcgactgtatttgatttcagttaaactgataataattgtcatttacgtctcaaaagaattgaaatatcatgtctctcaagatatggacttacatattgttatgcattatttatcaaaatatgtggacaaaacataatatcaatgtcgctttcagaataattgaacaacagatattgagaaatcaatttttatggttatatcaattgtcattgccaacatctattacatagtaacagtccaatttacattacaatggtaattcaatgaaggtaatttactttttattggtttactcgtgaaacgacgttctcctcctcacgtaccttatcttaatatcctgatcaacggacaccaattttcgacaaaatatctgagaaagaggacacgtcagcaagcctttcgctttaggctgcattgggccgtgacaatattcagacgattcaggaggttcgttccttttttaaaggaccctaatcactctgagtaccactgactcactcagtgtgcgcgattcatttcaaaaacgagccagcctcttcttccttcgtctactagatcagatccaaagcttcctcttccaggttcgaatccttgatttctccatgaatgtgcatggtagtccaacaattgtcgatgtttttgatagagagttttgtagattttctccggcgaaattccgatttgttcttcaatattatgtgcatgaaactttttttttaagattgtgcgtttagatgcaatattcgactctttgttgttctcatgctcgtcgatttcgatgtgtttctgttaatccattgatcgtatcggaaactgtgattgattgattcatattttcgtttgtctccagct

SEQ ID NO: 4524 - DNA, 295 bp, Arabidopsis thaliana
agagtagagagacagaagagtgtgtaaactgtaaaactatcgaatccttaacattaatattaatagcaaatgtcattccttttgtttcctataaacaaacttagaatatgaaaagaaacgaaaaaaaagaccaatattctacaacattggacgtcgtgacgtgtaaatacgccattggttaaaacacaccaagagaacccattaccaaagtctcacggagaatcccatctctttccccacgccaactcaatctttttcgtcgtcaaaagccaaagctttttgcttttttgtctta

SEQ ID NO: 4525 - DNA, 1338 bp, Arabidopsis thaliana
acttgtataatttctatattcataatgaaaaagctatagacgagtcgtggttggttagtaatcaatcatgtaaaataataatcgtttgccttcataatttctgtgttactgatgcctaaagttatgaatgaaaatagtatcctatatttcaatttgtaatgtttcaatttttttttgtcagccaaattttttgatttaaagttcaaaagaacagattgtgataacgatttctaagagaaaaacacgtgtggcaagtggcaacgtgtagacaacaaatggttgaggggagaaggagcaccccgacctagtcctccgccttgaagctcttccaagcaagaatcaggaaaaccaaaaattagcaaataatggataatggaccatttcaaataaataaaataataagtgaagtacaaattaataaattaaagcaggcctgttttgctgccaaaataaataaattaaagcacttatgatatatacaaattttagaaaaagtcatatgattaacaaaattttacaagagtattttaagctaatagaccgtttagtgactagtgtgatcatcttgtagaggtctattacacgtgttagtgactagtgtgatcatcatacacatgaatttttctacaaaatacacatggatttttctacaaaatacacatggatttttctacacatacacatcccagaagctctcctaaatccaagctttccacaacccaagggtcccatgcatagtctaggtttatcgaggcccaagcttagcttatgcatacatgctccttgtagccaatatgctctagaatcctgactccacaaacatgagattcatgtagctcaagttctccatagtccaggctttggtaaacatggctacatatcattctttagattttctagattctagcttccgagagaccgtactctgaacgttaactcacgagtcatgtgcattaaatgaaatacatacacgacgttttgtatacatcacattcaatctaccaaaagtattattttacaccaaccaaatggatgtaaaataatacaaaatggaactattcaacataagtataccaattcaatgtccatttcataagtataccaattcagccacatataatagttagcagaaactacataccattcaaagttatagctagtttatatatttgtaataaggacttttcaccagttggactttgaagccaccaaaaaaagtaggtgaaagtgagttggtggggggattcaaaagttccacatgacaaatagataatcagtataaataagattagttcttcttatattgtcttattcaatgcacacaaacatttacccaaa

SEQ ID NO: 4526 - DNA, 768 bp, Arabidopsis thaliana
gatggctaaagacatcattttgtagaagtttcaagacccaaccgggtactatgcaataatttcgaaccttacggatccatgaaaccagctttgcttcacatcagatcaagtagttattttcttgcttagtataaacatgtgtttttggacgattttgaaagatacaattgagtttcagttacagtgctttccatttattcattagccaatcaaagtctttatacatcaccaaggattgagacacatttagactgctaaaggtgtcattttgagaagttatagaaacctttgacccgaccatggaatgatgtcgaactttaaggatccaagagctcacattttaggtgtattcattcattaggcaattctaagacttttacattgtacataatcactaatgatttgagacatatggtataggttaatttgatagatctgattccgaacctgagctattgccaatttgccacactacacaaagttacaaaaaacagaactcattaactctttgcttcacattcaagaacacctttgggctcaagcaaaaaataataatcaactctgtttccttacacaagcttgcacgtgtaggaacataccatacactcacccgcaggtgattataacaaagttccctttatacccgcctttgattcttcttcttaaatctctaaacccttttgccgtctccctaaaaccctaattctcatttctggggtttcacatttcatcttcaccagaatccatcacactctctgaaatctgaaa

SEQ ID NO: 4527 - DNA, 1565 bp, Arabidopsis thaliana
ttaggactttttaagttgacacctagctctttgtaatagaactagtttggatcttggttctcatctattcctctctgatcttagaacaatatttataatgctggattgactttcttatgacatttttgttttcagaaactcaaaaaaagaaaactgagtcccaaaataatatcacctcgtcggactgagtttcttatgagtattaaaatgtgggttctagaagatgatgaatctcataagaaaactcagtttggatcatgattcatcatcctcgttggactgagtttttttatgagatttttgttttgtttgaaaaaatatattgagaaactattaaatcgttaaagatttcaagttcaagagaattgtatgaaagaaagaatgtgattgattgatcctaataaaaaacagtatgttctatttttttttagtatgatatcaaaattttcttgattaactattaatgatataatataaaaatcgtcaaaaagcataaaaatggtaaaagttattaatctaacataaaatttacttggaaacaatacaatttgtttcttcttagccataaaattgacaaaacgatataatataccgtaaaatctctataaattaataatattgggactgcaaaatttattaatttagagaggttttaatttatcgataaattaatattcattattttatagagagattttcctaatttaataacttttaaaaaatttctataaattttttttcattatagaaaatattgttctaaaatcaataataagtaaaaatcatatcatatttagaaaacaacatcaaatgtttttgatacagtataatattaaaactaaattttaaataaaaataaatacaaatttatggaaaaaaatattagaaatatatttcaaagaaatttcttacatataaaatatatatataattgatacatttatgtaattattaattaatgatattgatggaaccatatatttacatagaactttcaaaaaaattattatcttattatttatcgatttgtgttaatttttatattggtttggtcccaaatattaatttataaaaattattaatttattaagtattaatttatagaagttatactgtaacttataaaaactacgaagatccgcaagtgaccaatcaaaacttcagctaccaaattagtagagataaaataaaatgaattatagtatgaataaaatgagaaaatgattacagaaacggcgccgtttaaagatcggtgcaaatcaaattgaagaagactcatcggcgtcggtgggaatgatttgattaaccgctggacaattaaacgcaacgcggctttgcttataagactcagacatcgagacagagagagagagagagataagtagtagtggtccattccatcgaagaagaagacaaagtgaaacccaaaagagccgttgaagcgtacaatctaaggcagtacccacaataaagcttaagactttattattgttgctatctctttcaatttcagtttcaagatagaaagagcaagaaaggcgcagtctttgggggtttctcgggtc

SEQ ID NO: 4528 - DNA, 2000 bp, Arabidopsis thaliana
ccttgaatataaaaagttaattatctcttatctcttattttgaataaaatcagcatatatgaacagcgacaaaagtttgtttaaaatgtgattttcttcaatttgtcatgttcggacccgtccgacggaaccggtccaaattggtttgaaaagcatttgttatttaatcaagtcatacactaaaagctttgatcattgtgagtagtagtatatagtgtagaggaagtatgtgggatggtggtctaattgaaaaagtgatgatacattgaaactcatcactacacataacaaatcacctgtcaatgtctctctaagtgtttgggtctttagctcttgatattgaagcctgtcttcttctttttattttttaagatcacgtgaacgctcaaagtttttgaccaacaaataaaatggaccccttttatgttcacatccagaccccaacttttataaactaggtcaatctagctcctaagctttaatcatgatttatttacttacttattcaattcccatttggattataagcacgtgatttgaaatttgtgaagacaaatagaagacttaatttgagcaattttcgagatgattagcaaatagggagaagtttcatcaaacccgaagctaaatctgatcttttgtttcgcccaaagaagaaagaattgcttatgaagcgatatagtcttgataatggagaattgcccatgtgatggatgtgagagccatttaaagttatgaagaaacataataattctcacacggaaatataatgaaaactaaaatcatttgtactaacacatgcatgagtctattcattaattatcaaaaaatgttggtttgaactgaacgtcgacatgatgaattctaagttcaaatgaaaattgagtttctaaaaacaaaaagtttgaggatttgatttaaatattttgacaattgtttctaaatgtaaacaactatacgccgaaatttcgatcaagttgttagaaagaaataaacttgaagtgaaagtgaggagatagaattgaatatattgtcgaatatggagagagacctccaaaatcactcactcacacatacataccaaaggaagatgacttgtattaatgggtcccttatattcggatacattctctttttaattacgaatgctacaagtggatgtttctcggccaacacgtccaaaaactaatttgattttttcttaacaaacaaatatagattctctgttcacagtattttttttaaaatctgattactagttttaaataatatctattacacatgccacggatccacaagcgatcaatcatccttctctaactatctgttcgagtctatatctagtaagacgaccagaacatgctacgttgaattggttaattaacaatgtaaactatgtaagtatttgtctgacgatcaacaatttataaactattttaattttttttttataaatacttttatttatgatatctcgaatactcgtaggccatgataacagtagtaagttcgagatctgttctatacttagacttcacacataaaacttaaactctaaatctagggtatatactattatactatatacactaattttctagattatgtcattatctgaaaacaatgatgtaaacaaaatctattaattaaaatgagcttttaaaggattgtggattagatattaattaaaatcatgtcatatcccttaagtcgccataattaatcataactaaaaggcttgtcttgttgacaaaataaaaataaaaggcttgtctttttttctctcttttttttttccggcaactaaaaggcttatctactaggaattctttttttgttaaaattacttaaaaacaatatgtaatatatacaaagatattcgatatatatattacaaagcttctatttcagacctaagcccatctctttgttacatatcttatatatctccctctctccctcttctccttctctcttttcagctctcttcggaagtgaag

SEQ ID NO: 4529 - DNA, 1047 bp, Arabidopsis thaliana
acaaaacattttatacatgaaagtaaatttaccgaatttgtaaatgccaatactgccattcaatgtaaaagacatattgtaaaacattaggcgcaccaggcaatgtagctctggcgtctacaatgtatgtatcccacggtctattacatcttcagaaactacaatggtctgcttctcgctgtcggtggtgttatatcatcgtcgctggcactggcaaatactatgactctcatagcgaagattacaaaacaaaatttaagaaaaattttcaatgttcgagatcaagacgacaatagactcgtattttaggtctcagaagaactgctctgatgaatgataccatttgaaacttgactcgattataaagaatgttgaatgttctgtgtttttgatagatggttttacaacgtatacacaaaggtaaactactcaaaggcctagacaagacttgccgaacaagtataacgtacaacacaatccaatgcagcctactaatgataatccattgatttgactgtttgagagataagagatactgtactgtagttcttttcttaataaggctttcaccaccaaagtaactaaattttttgatgattttgcaatttcagtatccgacgttttcgaagctaaaagatttttctcttttacttttcgaaacaatcgaaaacaaagctatcagtggttttactttgctttttttccaatgaaattctattccgacttttgatatttaagttttttacaaatgtaagaggaaaattaatttaacgtcaggtcattcggccactaagccaatggagacttagtaaatagtgtggcccagcagaggtcaatagccgctacgatttaccaaattgagaaggtcgttatgcttctcaaccatgcaaagtatctcatattttggactcactcgaacgagagaatttgatcttatttcgagtggactaaaacgtaagtcttatcttcaataattatttgcatcgtctctagtacgtttgctcagattactaaatttcaaatttcagatctctcactttctgtaaa

SEQ ID NO: 4530 - DNA, 615 bp, Arabidopsis thaliana
aactctcattcgcttttttatagataattaacaaggtgccaaaagaactggagatggtactacgggtcaaaaggcgggaagaacaatttcatgttcttataacatgttagccatgtacaaaaagaaagaaagcaaacaatgaatgttctcgttcattgtggaagaaacatgggttaaagatttgagctggatcagtgcgggtcttgtatggttttgttttttttacgggttgcgtccatcttttttggtctgtagttttgagtaggttagagagacgcgagagagagagagaggatgtggcggtttgtattatgtaaatgcttgtcttataatgagagagaccttattgatgataccaatctttgaggtccaagtaacacaacttctttgtgattgatatgtatgagataattaatttgtctattttcatggcatgatgtatgtgatatgtctgagatttgcaacattcttctataaagttgagaaataagggtagtttagtctttttaaccaaagatttttatttatttgatcttttccctgttttaaaaagaagaatcgagtaatcgggtggttttgaagacgaagaaggactaagacatcacgaggaacacg

SEQ ID NO: 4531 - DNA, 695 bp, Arabidopsis thaliana
aatctctatgcaatgatgggaaaaaaagaagttaagagagagttaggtttttcaagctatgagagtgtataaaaaatatttgtgtgaaaggaaaattgtaaccaggaatgagtaattgttgggattgaatacgagattttaggaaatagttacaataggaattcttcattaaattagattgatcataactacaaaagttaacattcatacatatcgttaaggttcgatgaaccataaatagatattccgatatttaaaatatcttatatgattgtattaataaaatatctcatatattcaaaatcatatttcacttaactatttcgctgtcaaaaaatatcctaccacttttccaacatgacaaaaaaaaaacatactacttttctatcgtggcacgtttaaaaaatcatatcattccaaaaagatttactcgtcagattaaatatctaatcatcattggattcacaatttgtttatttacctaccagacactttaaaaaaaaagattaactacagaataattttgtctaaaaagaaacggataagaacacgtaagacatgtcagtcttatcttaaaatccaagtcagcatctcgtgtaataataatctcgtacctttataaaacccctcattgtcttcaacaaaaacataacacatttcaagcattggattaatcaaagacaaagaaaacgaaa

SEQ ID NO: 4532 - DNA, 2000 bp, Arabidopsis thaliana
acaccagcctaaaaagagagtttaaatttggtaaacgataacgatcaccttaagaaaatattaagctcaagaagagtagtagttagtataagattaagttggttatgaaactgatggtgtaacttgatggccactactactcactgacaccacaagttgctctaactttgagactgatatgtttcttttagattgatacattgcttctgatataggccataatcatttaaaagctgtttttgctgtctttctctctaattttcacgtcacgtagggtcaaatttcacctgttttatactatttctagttgatcattgagtgatttgcacgttactgttcagattagacccacccatcgcactacaatagtattggatgatttataaacttatatataaagcgtaagctatcaaacacatccacacaaaactagactgccgtaaaaaaaaaaactaaattatgtttttttttagttcaagctctcgaatacatccacacgaaactagattgccgtcaaaacaaacaagtaaattaagataaatcttaaagtcgaatgcacactgaacaactaaactatgtatatacgaaaatctacttgcacatgtgcatcttttgttattacttatttgctttttactatttcatattaatgattgcttcgacatattggaatctaatctcaaatcaccaagaagtagtggaacaaatcaatctttgtaatttgtcttaattttacgatatgaagaagtacaattcaaatctaaattctttaatcctgaattcttctgtttgatatcgtccctaattccctaataaatctaaaactttataaatcaaatcgtatgacgtattacaattttaccgtatataaatatagtgtattattcttggtggttttaccgtatataaaatacatcacagtaatccagtcacgtgcttttccgttggtatcaatcacgtgtctgtcaaggttcgcttcatgtgcaagaataagaaaaaagcgggagaacaaataaaagaagaaggaatttgttcagatctcgcagcctttttatcttcaaggtttcagtattcacatgcatcacgtgagaatgaatacctgatccacactctggatctatctgtacaacaccctcactgtttttttccttattatttcagatcagataatgcagatgtttatactttatagcagttaatgcagcctaccaaaaaaaacatttattgtttatggatcaaattgtgcaatatctatatttataagtgaaaacatttttccttcatgaaattataattatgggatttaataaagttcaagaaatacactgttttgttctattttcccagtgggtctttttgcagtagaattaaactttttctccacatactgacaaaaaatatacagaatgtcttgctttgaaaaaaaaaaaaatcataatcatttgcaaagtggaaaaaattattaatttttatttcaaatgttttattaatagtaaatttcaggatattaatttatgtcgtgggccaacggacctaacagccgttacttacctccgtcatttgtggcggcaataaagaagaataccaacgttaccggtttgagtttatcggtttggttcaattggttataacaaaaattaatttatattcctaaaaacagagaaacactcataaaagtagtattttcactaaaatacaaccaattaaatcataagaaataaaatgcattcgaatttaacaataaaaaaatgtattgtgaataactgaaaattcaatagttgatttttctggttaagtatggtacggttcacgtaaaccagtacagttagaaccggcaaaacaacccaaatgaaaaatcccgtctccgttatctatttagtataaaaccaaccacttcgtcttcttcatttcttcacaagtcataaccgtttcaaattctctctctctttctctttctttctcaatttttgtagtttcatactctagcttactaatcaaag

SEQ ID NO: 4533 - DNA, 2000 bp, Arabidopsis thaliana
gatttagcaacgactgtaaaagtgtaaagtatatgtgtagagataccatctttttcttcgacaatgactgtaaaatctgttaatttttttgttttagtttgtccatatttcttagttggaaattagaaaaatgggaaaaacccacgcttgcagtctatatatttcaatggttgtttttcaaaataaaaattagtagccgagttagctagtatcattagtgtgaaagcaaatgttaaaaattagatatttttctactatattttcttttttagtttttggtttgcgatctactattattccgagatgataattaaggtattaaaccatctccatcaatgattttttattgaaaaactgtttaatataaaaataaaatataatcaaaaagtaagagagagagtaaaattagtctctcaagtgaaaaactctgaaaaacccataagaacacttgtatatcatctattggtcaaatattattttattattaaaatttaattatagaactaatatttattaaaatactaatatatttttttttaaaaaccaataaggtatctcactgatggagatgcctttagaacctaccaattaaatttttacatgtgagtcatttagatgattctaaaagagttagacatctttaatatacaatgtcataatatcaatatggttttccattcgcaagtaaaaagttaaacattatcacacacttacatgaaacaaacgttgattccatgaccttcatgttagataaaaactcgaagatcccataactaaaactccgaataaaaatgtgttgttcgataagttgcgttgaggttcaaataataataaattaaataaatatatacaaaattttcgttactatcgaaactgtatcacactttgcggttttgtcattattcagagtcaaaacatctttacaaactcttgggattcaaatcattcataccttcataaatttaaaagaggcacatttaaagctcaatcacttctttaaatataggtagatagaatcataattgatacagataaacttagtggccaaactactattagtaaccaaactcatcttttcattgaattattttgggtaaaactaaagatttcaaaattggatacatgtagtattttttttgtttggaaagtgtaaatgtgcattgacaggtcccatcgtcatgtcatttggactatggacgttacgcttttgaccactcttttgagattttgaccaaaataaatacatacaaaaaaactttggggctactctgtgaaaatccactatttatttgtacgagagcgtaataaaataaaaataaaaaaagaaacggcacgcagtttgcgttcccaaaaatatgggacgactagtcaaaatatctgcttacgtccgtcaactttaatgttgactgaaccagaataatattaaattattaaatatataaacttgtctttttcccattgtacccttcactctgttagatcttttcgggagaagaagaagataagctttgaataactttcaactcttagatttgaatctaacggctgagaagcctcctgcaaagcatccccaaccgtccagatcaaagcgggcccatcgctccctttagtttcccgaaaaggaaaaaataatacaatctcgaacattagcctggcccatttttgtaattatattatttcctttttagttttactattcaaacaaattcgtatttcattaagtaaaatttctaattgtactggaaaaagtcaaggaattatgcagaaaaatagaaatagccaatttataagatggaaaatacgtattaaaaatgggaatatgaaagaaaaaagagtagagaatattggaataaaaagtaaatagtgacgtggcgggataccctatgcctttacacacatatctcgcagatatataaacagcgtctgcttcacgccaaaggagagagagagagatctgatcggtgatttacttttagttcgtcggagagattttgatcaga

SEQ ID NO: 4534 - DNA, 1208 bp, Arabidopsis thaliana
tgatctacaaatcaaaatcaaaaatcaggatttagaagtcttaatcacattcttaaccaattgaagaagaacacagtgttcactaattaagagcttgctagagtttcgataatggcggaccagatcaaaaattgaagtcaatggaatgtgaagagatcatagaacttgtatattacctggagagacttgaaggtagctagattcttagccaaaattctcgctgagagataaagaaagaattctaaattttgcttggcaaagagggaaagaagatgaagaagaagaagagacaggtttatttcgtcaactctgcttcttattcggtaacatcgacgtcgttttagtcaccttcaacttctgggccttttgggcctaatgattcaaatttgttgggcttaatgcaagtttgattaatttggtgcaaaaccttattaagaaacacacacacacaaagttgtgaatttgtgaatttacttaactacgtacatatatataatcattaattaatcacggtgtttgtcaaatatatatggttacaaattcaatatgttttggacaaaataatatgtgcctaaatctgcttataaatgacaaaatatatacaaccactaaaaatagaagagatatttatcatgaattgtactccaataaaaaaggtattgactttagacaaagtatcatcctaagatggagtattttgcaaatacttggctacaataaaaaaaactgatagatttgtgtgaaaaacgctattttcagttattaattactgtaatcattaatgttgaaatgtcgttttccatcttatggttttattcttgtggagaattaatgttccaaaaacagctttgactctaataaattgggaaatataaaaaggagatttctttctaaatccaaaattttttttaactaaataagattattttagacatcatcaaaatatatcttgtcttaaatttgagttaagttgtcttaattaaatttctcggagtagtgtaataattttcatatgtaaattaacaattgacagcatcgagacaaaccttgcctttttggcattagataatacagattataattgtaattaaaaaaaaataaacttggtttcatttcttaataaaaagccttcaatctcaccaacaccaccactgtcacaactcacaaagcaaaaaaaaaactagtcttcttctatgtcaatcagagcc

SEQ ID NO: 4535 - DNA, 2000 bp, Arabidopsis thaliana
gttgagatcgacaatgtctctaccgtaaatcaaagatgaaacaagtcaaaaacatctttttgggcttataattgataaaaatacatcaagttatgtttgggccaaatagctcattttgtaaacaaagtaaaagttaaaacctaatctatatatacattattggagattttgtggccaaaagatcatttgcttatgcatttattacaattccctttgcattaaataatttgtgtctgcattaaatatacaaaatgggctaattatcaatattattatctacatatacatttttgcagtcattttagcaaataaatcctcaagttggaacttatttacaaagaatgccattagcattaatcattatcaattaattaatattcctaattattagtatttctttatctaatatttctccatcaattctaattacttttaaaaatgagaaatcttaggactttattaatatgatactttattaaagataaatattatggttatttaaagtttataaaatatttagagtatttaatgaaaaacgtttagaatatatataataaatacaatctataaaatcaaataaccatttcaaaagatttattttaaaattgatttgaattataaatcttttaataaaaatattattagaacaaaaaataataatgtttaattttaccgaactagattagatggtgggacgagtttagaatactatagtatatggatttttataacaattaaataaccatttgaaagaaaaaaataaattactttgaattatatatttttaaattaaagtattattaaaacaaaaataacaaaaaaaaaaatgtttaatttcactgaacattatagatatgtttaattgtaggacgggtttggtcgatagtaatacgagacggtataccacaggtgaaatctattagatatgtttaattttactgaacgagattagatggtatgacgggtttggattgatagtaatacgaaacgatatagtacggatgaaatcctaaatataacaattaaaatacaattatattatattaaacactaaacaaaacaaacaatattaataaaataaatataatttaaatttaaattatatagttataatctagattttaacttaataaactgtatgttattgtttccatattttttaaacagcaaaaatcaaacatattaattgtatactaaaaaaatagatataagagttgtacatttagaaaatacaaagcattaaatcatatatatctttaatctactaaacaaattaaatttttagtttcttaaaaaatcaccgaatggattaaaaccatatgtatttatttcataacggctaaatacatatactactcttacgacattccagagttcttgtatttttcacaaactatatagtctaaaatcaagtaaaataaattgaattttacataatatagtttatcgtgcttttattagatgcactatacattttaaccgtaatcccaactaacatactaagaaaacacatattataaatatatttgattcggatccttcattaatcttttgctaaaagccaaaaacaaataacgacattaaataatccaatatattccgagatttgcttcgtcaatatttttaagggaatgtgacacgtttacgcacttttagactatcttattcctttgggaatgttacactattaggcacttttagaaaatctttttacgtttgaggcactttccaaggttcaggcacttttccttgtttctggaagataaaaagacaattatatcctttccaaattaaaccataaattgtttaaccagttcgattggttttgttttctgtgttatctaataaaacacacgtgtaatacatgttccttctatttcgtgtcggttgagatcttgagatgagaaagagagttatctcacaattacagcaaataaatggatatttttaaaaaataaataatatatagtgtcgctcttcatctctaaaaccaaattctt

SEQ ID NO: 4536 - DNA, 2000 bp, Arabidopsis thaliana
aattttaaaattattttatttcttttgtaagagcaataaagaacatatattagtattattttgggaatacaataatttgggtggatctcgttcgacgagagaatcaaacaagtcttgcgttttgtaagattcgttggccacaataacatgcatagcgcatgatggtggacttttcccaaatattcaattaacattaaatgaaagtttctaaattttcgttaacaaaaaaacaaaaaagagaaagtttctaattttttatatgaatattactactaaaataatttctattttattaatctgttctcgtgtgtactttctctgcttttccttaggattcatttcgcctggacaatgtttcattgcatgtgtgtaatttataatcgcctctcgttttgtttaatgctttgcttgtacttatttgtatttcattaacttcttcaatggacatatcgacagtaacgtcttttttttattgttactatagtagagtgaattaatttattcgtgtttatagtgagacaaaaacattttggtacacatgtacatgtccaagtaaaaaatattccaaagacattggatgaatttaaatctctttcgaaatagtactattctattctatattttatatcgatatgaatactatagctaagaatcctctagttgaaaatgtgtaaaagagtctttggcaaaatctttgttcaaacaataatatttaaaaatacgatctaaatagtcataaagtttttttttaaaaaggttctagaacatgtaattcgaatacgtttacacatttactactactagtaatgtgtacatacatactccatacgctaatacttgtaataaaacgaataagagggtgaccgacctattttattcatttactatagtagtattaagttcttagtccgagttcaattatagttttaatactaaaaccacataacgtgtcacataggtgaaattctgtatactattataaatatcagataccgactagaaatatcacatttttatgctcttgattcatattataatcctccaacatgagacttttgactttttaaatcaaaggtaagaaaacactatcatgatttattaaattaaataagatcacgtcaagaaaactcaatgaatctgagtaagcaatgactcacattacgaacggcaaaccaataataaaacattaaaaatgtatatatttaaagtgtattaatacatacaaaaataaaaggtgttttcgtgatcaattataataaagttccaaaaaaagaaaggaggttttacataattggttaggaccacacaacttgtcatctgtcgatacaacaaggcgtcgagctgactcagattaatgagttaatgggacccacaatcacctctcttttgaaaggcccaattatcaacgtccttgtctcccgggcccacgacagctgcccttgtaccccgtttgccctacttttttcttttttttttaaactcacctgcagttgacacgtgcggtgatcctcgctcgtgcgccagctaagatccgagttcgtgctacgtggctgttaggtaaaggtcttaaggtttgcatgggaattaaaatctgttgttttgagtctacggttactatttgatcttttagggtcgtcgtgtatgacacgtggccttagttactgaagaatgatctcaaccgctgattaattcgaatggtctagctctacgctatagccaatagctactttccttttgggcggttgtaataggtaggtacgacttatacacacaacgaaatattcatagctaaaccggtttaatccgatataaaaaccaatttgaacagttccacgtaatgccatgtcatatatttttaaccaattatgtactgccatatctacaactccacgtaaacttctgtagttactaagtgggccggttcgtgtcccaaattaggcccatatcaatgggttttgtaaatcaacggtcgctaatgttcccagtctatcggtgccgag

SEQ ID NO: 4537 - DNA, 2000 bp, Arabidopsis thaliana
cggttcacctcaattaactagtcatttttgcagatttcgaaagtgagatagatatatactttgatttgacatacttacaatctgatacatacatgttcaatgaaccattttgtttttattaatctgacctttttatcgtatatcaactttcattttgaaaaattagctatttgatattgacctaatcttttgattgattactgtggctttttccctcttgttttatgacgatgcaatttaaattcaccaatctagatactccatagcatatgtgatatatactctgaaaaggtgttgctagctaaatgagatgaatcgctcattcatatgtggttttgatttttgtgtttctcatgacacttcttgttttcgttagcctcgctaaggcgtcacatttcatgaaaccttaataaaaaagcactatttggttagtttgttttaatacatgatcagattctcagtttgtatttctgaccaacaacaaaaagaaagaaagattctcagtttgctgttaaactatttttaaaaaagtgggatttgagacaatcccacaatcctaaagctgatgtattgcaataataaatttaaattatctccgtcagcaagatatggtttgcctacccaacaatgaagaatagtataatcatattctataataagaaattgacataaacagccccctcggattatgctaattagtccacttaattacttttatttaggtgtatcttaaggacattttcttgtctatagtaagtaagataaagaagcaaacaatatgattaaaaattatgacgtcgtcgagccataaataaaacaaaatatgtactattaaataagcactgcttaatctggcaccaatcacatattcacggcgtaccaccacttgagtttgcaactcgtcgtcatccagtcatctccttgttgtcctaaacttgtgtgttcttgtctttttattccactcgaccaaaagggcgtggacacactcgcctgatacttgtcacacgtccttcatacgggctctctgctaataaaacaagatggttttttttgttgttgatattttgttgtttccgttttaaaccaaatcttactttcacattgttttcacttttgtcttacgatctcattccaatttcttaccaaacatggtttaaaaatttaattaaatatcaaaacatctttgttaaaaaaaaaacccccaaattggtactcttttccaaactattacatgtataagcgttgggtttagaaaacagtaccaatcaaacttaaactgggaatctataactggaaacctatcacatattcaaactaaaaatgggaatctataaccacaacaattaatactcaatgattaattattaaataagtttagaggaaaatgattaatataaataaaataagttaccctaaaaagtatttaatttgaaaaaaacttttgtaaagagttttattatttgtagaacagagaaaaagccgctctctctccctctcctttccactctcatctccctctctctatatcctcctcctatcagaagagctctctcttctctccgcaccgattctgatccgaagattttcaggtaacaatatcaatgtctacaacaccaacgattctcactttcttctttcttcaatcctttttcatttgttttctcttttgccaatcaatgatttaagattgaatgaaattctcacgcagcgatgcaatcttatttctctcaaaattctgtttctgtttcgaaattccgacaatcttaccaatgttcttttgtttgtctgttttcttgatgtgatctggggactcaatcattgaagcttagaatttttttacatttctccataatcctgttcttgagacagaacaagagactgtttgactttacaggttagatctcgtcaccagttatctttattcggatttgattgttccgacaatcttaccatttattttcttttacacgaattcaaatcagatttcataaagtgaaaaa

SEQ ID NO: 4538 - DNA, 874 bp, Arabidopsis thaliana
taacatactcaaaactaaaagaacagtcactgattcaaatcaagcacaagaaaaaagtcaatgtaaaagtacagaccagacaagagaaccttagacaggtcagcctaagctagaataaaaccataatttgatccttttagctccatactcttcattacatccacacaaacaaataaagaggcgcataatacagtaaaaacaaacttgcaccagattgaacctaaatggattaaagatttcaccagactatcataagctttcactcagctaaaattcatcttcttcactcagctaaattcatcatacatagaattcttaacaaagaagaaatcggaaaataggaaaaaacagaggagagatttaccagtggtatataaagcgtcgtcaatggcgttgaaaaatatcgctaggcataccggagtttaggattcaacgagtgacaatataaaacgatgatgattaacaaaaaaagtaaaaagaattcaccaccgtgtgagaaaagacacgtgttatgatctggagatagatcttgcaagtgggttaaataataaacggcggagacatagccacacgtgtgaaaaaaaaagaggtgtgtgtgtgtgtgtgtatgtgtgtatgtgtgtgtatctctctctctcttcctccaagtagcaaaaagcaaaggggaaagagacgatgcgatcgggctaagtgcagaaacacttatacttgtgcattctgcaacacaacacacacacagagaattcgacgagagtatgatttgagtgtatcgagaacagagagagacattgatagagagatcgttggcaacgttttggggatccaatgcgttcgtaattgggaaagacatttcattcaattctaaatcgggaat

SEQ ID NO: 4539 - DNA, 1240 bp, Arabidopsis thaliana
tagtgattacatctcccacagttgctttgtactctctgtttgaatagcaaatccacattgtggtggatcaagaaaccgtggaatgtagccgcgttgaggcaatgacatggtatgcttttgctgcgttttttgtcgcctgttcagtagattctaaagactggagagtgggatttagactattatcaccaagtgaagggtatgaatctatctatcaagattctagacatgaacaacaaaaccaatgttcttcactctgtggtgattaagttgttactgatgtaaaagtacaaaagttttgacaaaatagaagtgggattttctctaagtggccagttttaaacagggacactaattaagtagcaaaaatgtgaactttttttttttttttattgcaaaggtttgtactttttttgaattgaatattcctccgaaagcaaccaaattatcacaggttgggcatgacagaagcagtgacatattaatacgtcgccgaaattgactctgaagccttgtggactatgtatatagataatggatcaggtgaatcttcaacttatatagctcctggttgatgtcttattccacgatcattagcaacaccagcttcctctctctcgcttcaaagttcactactcgtggatctcgtcttcaggtacacatcatcacgattgattttccttgatttccaaattccatttctctttgtgcatacttgcattagattcttacaggttttctgggtttgtgtttgatttgggtatggtctccatgatgcatcaaattctgagaattcccaaaagaaactgattttgagctaaaagttattaacgtttgatccgtttaggtccatactatgatgttctgtttttgttcatgaaattgaaagttggtccctatgcttttgatttgtcatcagtgtacagtatcaatggctcgatctgcggttgatgagacatcagattcaggagcttttcaaagaactgcatcgacattccgtaacttcgtttcaaaagattccaattctcagtttccagctgaatctggtagataccatctttacatatcgtatgcttgtccatgggcttctagatgcctttcatacttaaagatcaaaggacttgacgatgcaataagcttctcggtgcgtagactcaaccctttaacactgcttattgttatgtagaatcataccatttcctgatggtattgatcgaattgttctttgtttgatttccatcag

SEQ ID NO: 4540 - DNA, 1319 bp, Arabidopsis thaliana
tgagtggtgaggctcatgctcatgcattcgtaacgttgttatattatttaattaaatggaaaatgataaattaattattgcaataaaatgatacattagcaattgtgtatgtcgttatttttattttgagtcgcattgtatgctgattccatatgttcggctttggtcggtttcaagtgtggttaataaaatggttattttacttttgccaacagttattgagtggttgtgtttatgttttatatacatgttcactcatctttccatatgatcttacaacacttgctaaaatgaattcggttaggtgaattttatgagtagatacactatgtaaataattagtaaagtaatatgatatttatttatcttttggaaacttttaaaacaccaaacttaatattacatgcattgatagtgatcactgtaaaattttgtactaatctaagttcaaaaagtattacatgagtatgtcttatcccaaatttagtctcaacaattgcaaacttttgagacatatatacagcaaactcttatctcacataaaaaaactttaaagttatgagtaatctaagttatagacttgtagtgctactctagctaaattaaattcattaattctggagcataaagaaatctgaaaaataaccatcttctcgatcatgtcctttgcttagcataatatttcttgttcggtttagcgatctcctaaaatgcaacgtggtcactttgccacatcactttgaagatgaacaatctacaagctgacaaacgtatctaatgtgtttgtccgtatgttaagtttatttctgtaattttgaacacatgtgagaattttcaaactgatttaattccgattccaagctatacgtaagaaatttcaactaacgtggattacatacttttctttgagtccgaatacaaagacttcacattctattttgttttcttctttcgaaaccactaagggctactaacctctcgaatcgacaaacgtatccaatgtgtctgtcgttatgctacgtttatatctgtaattctgaacatatgtgagaagagaaattatcaacggatgcatgtgattccaatcccaagttatacgttaagggattttaagtaacgtagaaatcacttcatgatttgagtggcccttagctgcttgaccatacttttgttctagcccgaatacaaaagacttcacgtatagctttaacattttctgagtcaaattgtgcaaaaccacatatctgtatttatacccttcttctctctcacatttcttaatccaaaatcattcttctaaaagatatttcaagacaacc

SEQ ID NO: 4541 - DNA, 1500 bp, Arabidopsis thaliana
cgcgaaaagagtgatttaagaaattttaagatgcttgtgatgtgaaaaagaggtgttagaggcaagacgtagctacatatttttctttggaacaatatattaattagacgacaactattgttactctgtttggagttaacgtttgttttgtgctatgttttttgaatatgatcgaaaagttcatgcaatctgcatttccaacctaatttatgggcagcacatttgtgcttttgttaaaatttgctgggcttattcattatactaaaccatgcataaaggcccattaaatatcttattgtaatgtgacggacgaaaaaaaaaacgtgagggaggacgatggcaattgcttacgatatattgtaaagtggatgtgacctgtctgtctacacaatattacaaagatggtcgctattactcctacaaaaaataatacaacgcaaaacaattattgaaaaattattcatcacttttgtatctttcaaactttcacagttcacaccacctaaaaaacagtaaaaagtaacaacattatcactttccacaacaaaatatctaacaactttgagtatacagaaatgtacatagtacatacgtataagcaaaatgaattttgtttctccttttttttcctggtgtatatcgttgcaaacttgcaattgatcaataaaacgcaaagatattatattgaacaaataaataatttttatatagccaagatattatatggatcctcattcctcaaatataataatttacatggcccgcgattatcatgaaagacgttgaaacgtccactaatcgtacctagttgttctgaaaatgaaatgatgattttataaatgatatggttttagacttttgaagttcttcatcacttattgttagatgaaacaacaacgttgcattcaaatctcaaattcctataaatcacagataaaaaagtaattttgttttacacgtctacgtggttacaaatcctaatcacgtaactaaacagtaaagttaaagaatcttgaaaaataaagatctactttacgttttgtagatatttttaattaaaagtgaacgtcaaaaggtaattggatattttcgttaaaatgttatcaatcaaactcggacaacaattagtggtaatttaactatttaaaaaccagactaacccattatcgtatagtgctaattatgaactatgaaccgattaaacaacaaaatttactatataaaatcatcaggtgcttttcttaatctcaacggttaaaaaaaataaccaattagatgtgtccacgtaagcaggcgtaccataagctaccaaccaacacatacaccagattctcaccaacagaggaaaaaagcttctactataaagcacacatcttcttcttcatctctctttcgctctcagaatcctcttttaagtctctgtttcataaataaaactaataaagaagaagaagaaaacagagcaattaaagtccttaaatcttcttcttctccaattca

SEQ ID NO: 4542 - DNA, 2000 bp, Arabidopsis thaliana
acatcaccacaaccgatagaatcatcaccactaccctctgaaccatcacggcatacaatcatttttgcacaaaaagttaaccatcggtccgtcagaaaacttaacaatgtacaatcatctccatcctccagccttcttctcttccacgatcaccatctttttctgccataacaacgtggatctaacttcaattcctccaaaaagaaaaccttagcggcgatgttttgttttaataatagttgtattcactcaccaaatagttaagatttttgtttatacactcaccaaatacacgtttgtcaacctttttcttctctttgccaaaaaaaaatcatttgctacacttttaaatacttccaaatttgaggatagccacctatttttttttattttttttttaaaattattaatcaattacttcaaatgaaaacaattaaaagctcaaaattttctattattgctgagcatatataacattcaagagaacaaaatgaaaaatacgagaatcaaactattggccacagttcacctgctccaaatctgttgtagtgatgattgtgtctagacattaaagcaggagttccaactctgttgtcgtcctctgtgacactatcatcggaccggtatcatcggaccggtaacacgggctaaagcatcagtgtacctctcgaatggagtcctttccaaatcattaggcataaaccaaattcatccatcatctcattcatacctaaaaatgcatatatctcggatctcacatcatctagagactaataatgagtacaattaacgttgcattcagtgattgaaatttcttattcattttgttgtacgctgatcaaaacttcttatctttttttccgttgaaattaaaaacttttataaaacgttaaaattaaaaatctttataaagaatttgatagaaaaaaatcgcaacgaacaacaaatgcgcgaaaaaatggcggcaagctttttgaagaatgagagtaaacaacggctatacatttggttgattttacagctatatatatatgatgaaatgccagtaatattgccctgtggcacatgaacaataatagcactaacaaagtaagaatccaaaacttatcaaataattgaaattaatattattcgatctgttcaaaagcatccatcgtaaaacacataacgcccaccataccccacattcgacatgctatcacccaaatcactccatcactcgctctcctttactcatttcataaggaacaacaaacttttttttttgtttttttttttcctaaatcgttgttttcaaataaggaaaaagctttgtaactttgtttgtaaggcaatcttatcttatcttttacacattcttactccaaattttctttctttttattcaacaactttgataaacctttctccctccctctattgactttgaaggtttgttttgttttttccatagttgtgtatttagtggtaaattatgatgaaacagacaaattctagtgttacaatagattataatgttcgaatatccgttgaaatctagatatttgatatgatataaaaaacggatacgtaaacttatttgaaaacaaaagaagacactaagaaaactataaacaaataaaggtaacaaaaagtaaatagttacattcatttcaaaatcttttgttattacatgtttggaattagagtaacttaaaagctttatagtttatattgattaatacaactcatacacatcccacatcccatcataattttgataaaatgaagactcgccaacgtgtcaacagatctagcaccgccaacttctcacatggcatcatgggttattattattatacacacttactaaaaccaacttcaatacgacgccatgtatccgcgttttgataataatgctcactttttcctatttaaataaatccttcattttcctccttttacatttcctcactcaactctctcattctcactaacagagagaaaaagcaaaagcaaaa

SEQ ID NO: 4543 - DNA, 2000 bp, Arabidopsis thaliana
ataatgtgtataaatgcagcatatcaactttgctcatttcgtcagaagggttttaggcttttagctattagtcttccagctatctcattgatcactagtttatggtgtcggagtccatccatttactaaaacaatgcatttcactacgaagctaatgggtaaatgcctagtgaggttcaaaaagttaaacatcaaaaatctagtggcccgttataaacgatcatagtgattggcccagtaagcccactaccacaagcattaagttttcaagggaaatatacagatagtaaaataattggtctaaagaaaattggaaaatttaacccgtgccaacagaagtatcaattaagttgagacatcagagatacaaaagttaaataaaaaaggtgaatcaaagagcatctttgaggtgttatggtctgattagaagccaaacaagaaagcaacaaaagatgaaacgagtgagtcagtcatatgagtcgactttttttgtaaacaattcgaaagtctctttattaaaaagaagcttccacgtgatttccctttctctggtcggtacttctctctcatgtccattcatcaattgtccatttttttcctttcttctgtagtcaaagaaataaatcatcatatatcgacttgctaagtgtttttatgcagacaattttgagtttcagcttaaactattaagcaagataaaaaaaaattggtgaacattaagcaagataattatcagctaaagttttttttcataaagttctagtgtacttcggcagataaaattcaactaattttatacattacaaaatatgagaccacactgaaatttaaattagacaacaatgtaaaaatcagaagataaaataaatccaacaaaggtagaatttaatgagagaagtagagttttgatctgtagtcaaagaaaagaagtcgattcgacgattagtggcgatacagattgatgttgtgttggaaaaaaacatcttgaaatttgctttttctaaatgtggtggactaatgttatgatagtggctagtggttgatgttagagccacggtaggtagatcgaatgtgctccattggctagaaccgaagggaggagttggcaagattcttgatgctaattttgaatctggacaactttagatggaatggtttaatttatcataatctacatttttattcgtaaagtaaaataaagattaatgctggtttgaacatacggtagaatcacatgacactttgcataatctaatttttgtaagtttatgagagaagcagattgtatgtactcttcctccaccaccacacgtgattccttcaaagacggccatacttgaaatttggcgttacacaccctcactctagggacctcacttttctctctatccatttcatttattattattatggaacaatgcttaatctttttggtaaaagagtaaaagattagtattgaaaattccaataaatgtcttttaatgcaaaattatttccaaacgtttagatataacttgtttgaccaaatatttaagtccaagagcaacaaatctggctctcttctcataattattttgaattacaaaatttagcatttacaaatatctctgtaaaaatttccatggctattttcattactgttgggtcatgacatttaacaaaagaagaagcaaaattccaattggcaacgtaaaaaataaataatcaaatggaagaatcattgtaattaattttattcaatttgcaaaacctttaaagagaaacaaaaacttaaaatgtttttttaatattccttatttggcttgtaatttccatttactttgtctaggcatttattattattaaaagtcagtttttgaactgggattttaattagtcaaatatagattctctcagattaaaaactctttaaaaactttttgtcataaatcaggcaaagaagtaaaagagacttaaaactctctctctctctctcttggtcttcctcactcttaacgaaa

SEQ ID NO: 4544 - DNA, 2000 bp, Arabidopsis thaliana
ctctcatagagatttggtaatttggcccaaaatatctttctactttgtaatatgtcgatgcatagaaaacataatcttattctaacattcacaaatctcctatatttccatattgaatctctcagtctggatcggtttgtaatctctgtccagctacctcttacgtttcaggtgtttctatgatttatccattggcttcattggctgcctataacttatatatcatgttgcaatctttgtgtgtgttgtgttggggagagcttatagccggccgctcctccattagcttccaaatggttgaatcagtctgtatcagatttaaactcagtgatagcacccacgttatgcatgatttttaagatttgataagcagactgtttttaacttcaattcaagagcatcatccactttcggcttaatatcctatattaatttctttaacaagctaaaatgaacataatgaaaataactacactcactgattggcaattactaatatctcaaaacattaagaagtattttttttttttttgggtgaaaagtcactgtctttttcttaaagccaaaatttatacggaacgacaaaacaaaaaatatgactaaaaacttcttaagcgcaatcactgaccatgcagcctattttagtttttaagtcttttatatacattggctgttatagtcgtaaaacaatcaggtatttgttatggagataacaatttgggaacgcataaatagtgcctctgatggttggaagtggaacaaaatcacaatatttttttctagtgtataaacaacatacaaatatcatgtcacctgcaaagagaataatatgccaaaattttgatataatacgcataacagagtttatatatcaacgttctagacttataggtgatcatccattatctttaacctcttgtagctagctaggttaattaggagatgcatgcatctagataggcatatatagtctaacattacaaatccatcaaaggttcccttcttcttctccaaagaaattagctacatacaaatttgacagactctcataaatatatatatatatgtttatagattatattattaaaaatacaaatgatattttctgtattttgttaaaattagttcttaagattttatgaaatttataattgagccaacgtcttagaaataattatacgacatacgtaatttaaattcaatgacgatgacttaaacttaatgttttacagtatttatccaatcaaattttaccacatcagcagagaagagtcaaacttaggaaaagtctatcttggattatcctgacgtggcttttttcaagtaagaaataaattaatgctaatcacgtacgtacctacccagcttttggacctcgtgggctatatagaaaacaagtaaccaaagagagacgaagcaaaaacattcagagagaaaattcagcatttttgatagctcaagcacttgattctttccaaaggggtttcctgaggtatgtttgctttcctttttggttttaatttgtttcaaatcttagatcgattcttcactttggattcttaaatcgattcttgtcctcgtctgtgctgatttcgaacttttccgattccaactccgccgaatctacgtatagatctttgaggaaatgtttttttcgatttatgatcggcggatctaccgattcctttgcttgttttctttggatgtatcacactcttctgaagatgccttgacctttttatgtgaactagtaagagttattatggcttagatcgttgaatatctggtatatgtgttcttataatgggattaggatctatgttttggtgcgtattaaagcttagttgagattgatgtttttgggttttcaaattctgtttcttgtctgttgagctaatttaatgttgtgtagaaccatttgtttttttctggatctttacttatttgtatatgtattggtttatgtttatgtttttacagatcacaaaggccaagtaaca

SEQ ID NO: 4545 - DNA, 2000 bp, Arabidopsis thaliana
acgatattcagaagggtatttcaataaataagtgtacatcgctattgcgtggatggaacgtctatttccaaacgccatacagtatccaccgaccaccgacctaaacttttttttttaatgaatagaaaaaataatatatattctattcttgtaacaaaaatttggagagtttattgtgactaatgtcagttgttgtttgtaattatttagaaaattgttcataattggaattaagaatacaacttttatcagctgaacggtttaaggttggatcacctattcacccacacaaagttttggtatttaattatagacaaaaatgtaagaaaaattggaattttttagtaagtttctcatcttaaccaaaaatatatagtaatgatgtgtttgaaaagagaagtcgaaattccctataaaatctacaactactatagaaaaaaagtttcgtttattatatctttaaaattttgaaatgtagtaatattagtaaaacaaaaaaaaatgaagaagaagaataacatagaaaataaggaaagacaaagctcctcaaaaatcccacttaacttgtccccagaacagaaggagacacgcgtgtcattaccgcctcttccctattaaacattttaaggcataaaagcaataaataagtaaattaatcgtattattgcttgaacatttctgtataatttttaaactcctaaatcagtttaagttaaataccatttattattgtttcccaaattccacaacaacgacccactttcctacgtcgatactattcttcttccatgcaatcaataaatatcctctgtttacttgtagtttcagtttattttatttgggtaagagtttttcaatttattgacgatttgacaatttgaacgacatacatatatcatacatatatagtccaatagtcaactcaaattgaatatatcgtagaattttataacctaaggttatttaaaatagttgaacgaattgccgtgcaacattaagaatataaattctagaataaaattttgtattttaccactagctgagatactagacagtctaagaaatgtaaaaaactcatttgcaacatctatcatgaaatgtgactgatatatcatagatttatctaaaccctaggataataggggataataatactaaaataaaattgacgtaattgatgatgaaacatgttttattttccaaagtgaggcgttaactcttatattgttgattaaaatcacaagattcacacaatatcaagacgcaatctatccctatccatttttaaattacaatatccttaaattaacgtgtgtataaacaattttaaatactcctttattttttaataacaattttaaatatacctatattatacaataatgatttccaataatagtaattaattagatgccaacggagaaaaatattagaggccataacaggctatgacaaaataattgtgatttgagctatgataaatcgttgcattcaaattttatttagttgaggatgttttaatgcatatagtaacgctgatatatcggaaattaatttaagaaccgtccaatggaaagagccgacgagcattattaaataagatgcatgagtgtatttaacactaatattttaattccgtccaaataataaagacaaaatataataactacgatttatctatatgtgtatatatagtgtcagggaagatgagattgttgtctctgtcttagaatatatatagagagaatcaaaaaaaaaaaaaagaatatatatatgagaaagagttattaagagattttagtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccact

SEQ ID NO: 4546 - DNA, 2000 bp, Arabidopsis thaliana
cttcggaagattaatcagaggatttaaaataatctaaattcgagattatgttgtataaatatccattttgaaacttgaatgaacaaaaaaccgataaagttttccacgaataagttgttggtgtttttagtaggttcatagataggagggtggaaggtctctagttgggcaataaattgaaaccgcttttttctgacctaccaaatattaatttgatcgaatcattgaaaaaaatacatatataaaattatccatataaaaactatgtagtttgctttaaaatatttcatcgtatgcaatgatatatgcatacttaatccaccacatgtcccttgaaacaaaagcacttaagctctgtgtggttgacattaaatcacacatttcattttgttaaaattaaagtctaaaattttattcatggtagtacatccatcatcaaagaccattttcattgaacaaaataaagtttcaatctctaatcctttgtgaaaattcttactactatatattaattaggtcttttggaatatagacgcgcaacacacattttcttatatatggattgaatggtatccaaatccccaaggtaatgtaatgtaaaaccaagataaagaaaacgagtatgacattgacaattgaacttgtagcgaagtcaggataggacgacttgcggtttctactttctaagccaaagaaacatagttttcattgatttttagtgtttttaaatttgttgttgacttccattaatggaatatttcgtactttgcttcttcttttcgaattttatttacctatataactttgctttattttctacaacacaataagtattgctcataattgaggaagtctatacacacaatattttcctatcctttctttttttctgtcgggaatttcttcatatcctagcatctagattatgattgtacacatacaaaaacagaaaagaactagacttcaaaataatgcaaattagaaacaaaaaattgctccaaaaaaaatatattcaaaactataaataaaatattattatgatttttcttctattttacgtacattgtatatctctagagaagaaaataatttttaaaaaatagtttgggatcaacgtcgcacttattgttttgtcttacaatctcagagtctcaccgtatccaccacgctggtcaacaacttcaacaaaactctcttcctcgaacttcaatcttatcccttcatttcattaccattaattcacaccaacggctaacattgtcctcctcgctaaactgttaattatacgtttggccgtaatgttttgaagtctgcctatatttcttttcaataaatgctcttttaattaggttttaatttggtgaaatccaacctttaaattttctgatgctgttaaatctaagagtttgaattttctaaaatcattgttgtcggttatcatttgtacatcttgatagaactataatatgatcaatataaacttataataataataactgaaaatacaaatgattttgtttgtttgtttataaaaccactgaaaaatgcaagagttaatccactgagttcaaccaaaaaataaagaagtgaattctattagtcataagcttggaccaaaaaatccatctagaagaaaaaaaaaattgaaaaaaaattacaagtttctaagaagatggtgcaatggttagaaaaatctctcaagttattaaatgcatcataaactaatactgtatattactatacacaaaaatcaaagactcccttttttttaattgaatcaaacaaaatccgaaatttcgaaaggtccgacttttcctcacctgaacccgcgttttctctccccctcccaacccaactctccaattcgccggaaaatcaccgccaccgtcacttccggcgtccatatgaactaaagagataagcttttttcttctataatccttcttcttcttcttccttgatctcctttctctgagtttgctgagtttcttaactcagcc

SEQ ID NO: 4547 - DNA, 1160 bp, Arabidopsis thaliana
ttatcagtcacttgtctttttgttatgattttgtcggattaggaataaatttttcagctaacaccactgccgctctgcttggttgaccttagcagaataggaatctcctagaatagaaaaaggaagctgtgatagctctatgttccggaatgtgatttaacacttttcacactttacatgtttcttctttctttataaaatgttcaccataacacttcccctgtgttctgtcataaatgcttcttcatttgccaagggcatcaaagattgatgaaataacagaacagtaactttgttgtaaagatttgattgatagtcatgtatcagttaaagatataggaagttctaaggggattatatgattgatccacattcttggagtactgattttgtttttggctcatttgtaacgcttttatttgtagttcatgttatctgatattgaggttcttttgatattacatcagttttttgctttggttatctgatcagcattttgaatggcaatatctttggtaaacaactagtggatggtgtgtgctcatgataacatatagttgaagtgcagtggtctattttggagaacaattgagttaattagattctaatattaattgtgtcactttctattttagaatgagacggagaggatgtgtcaggctataaaacatgtttctcctgatttaagttgtaatccgagtttgaagtcatgcgtcctttgtggacctgcagccacaaattcttttcaaatcatctcgaacgagacagacagtgtcaaaggattggagcttggtgagttgactttgactacgacagaggaagtaaggaattattttcactttgataggtgaactttgtgctgtacatgatataggcatagtgtggggttttacctgttgcatgtcttcacagttttacagctgaaactggagaattgactcttttgttctttactgagatacaaattgagctttagaggtaacactgagacttaggggaacccaaaaaatactacaatgagacgttaatggaccttgaattagtgatacaaagagctttttgtttaaaacctttaaaagctagatctaaaaggaatatatctccattcatgactgcatttgtaaacattgcttaatgaagtatcagcgcctgaaatatgt

SEQ ID NO: 4548 - DNA, 1123 bp, Arabidopsis thaliana
tgtcttagcttcttcttcttcttcttcttctagatctcacagatccgtgtctaactccaaaataaagaaaactgaagtgtgaataatcaaaaccaaaaaaatatgacgccttaagatgtacataaagccccatacattttgaatgttacaattgacactcattgttatctattttaggcccaatgggcttttcgatgacccaattagttcgacactctgcttctctttacacgtctcctacatacggacggtgacaatcttgtcttaccaataaaacgcgtttttatccaattcgcgcgggagttgttctaatgacgttagcaaaccactccgttcaatcgtgctgtcacgttatgtcgacaaacaaatccaacaatttactgacacgtgtcatttagcttccccaataaatgacccgggaatagttaaaagccggtttaccagtattggttttaatcagccaccgagtcatcgtgactgtaacttaaacggcgtttactgcttcaagataaaatacgctttgcccaaaaaacgttattagttcgtaatccgtttttgctctcccttttgagatcttttaattaaaaaaattccgttttaagtgaatgcgtgtaagcaacagttcgaattcgaagcgagagctaaaatcaaaatctctctgatttgttgttttgttgatgtaagtttctttgatcctttcgcgaaatttgtcatcttccccgatcgagttttactttttctttgtgaatagtttgacttttcgtttttcttcttcttcaatctcgcatggtgtttgtgcgtatcttgtttggaattggagtttgtaactatttgattataagcaagttttgattcgaatgcatgcgtgcaatccacaatccagaactagatgtatatgtatctctatgtcaagagtgattaaaatcgattcgtgtggaattaacttggaagtgaaagttttaatattgtttccggaatttacggtgagattttaggtgttgaccagcgttgttagacaagaatttgtcatcaatttgatttagttttgaagcatttgggttttggaattttgttttgattttctgcaggttttatgaagtgatttgcattagattggattgaa

SEQ ID NO: 4549 - DNA, 1181 bp, Arabidopsis thaliana
tcaaactcaaatccaaaccattagctatatagacgacttagatccccaaaacccaacgaagatcactcgatcatcgaccaaacagaagtatcagatcctcgagcaaaaaacccagcagaagaacaacgaagtggccacaaaggaactcaaaactcaggtagaaatcaatcggaagctacgcaatcagctagcctggagttggagcaaagattcgaactttggatcagtaattagtaatttacctcaacatattatgcaacaagcttcgtcctttttagtaacacgaagaagagagagatagagagagagacctaatacaatttctttgtagcttcagttccgaggaaaggaaacaaatcaggcttgttacttctcagacaaaagttaaggggttaaatggtaatatattaaaactatgaggtggaaacgatcaaatttggagcgaataatcaggtgtgagttatcattggtgaaacacaactagcaacccaaccactagtcgacacatcccaagaaaaatagatttttagtccaaatttatttacaaataatagactagaataattattattaacacaaattgatattgttgaccaaaaaaataaaatccaagtgaattattcatacaaaaatctaaatattttaattatattcggcattgtaattgggttccacctttttttgttgttgattaattgggttccactaaaaagttgtatgaaatggtaaaaataatagaagaaactataataaaattcattttgtatatatatatttaactaattgggctccataaattcgtcaagcctttttgcatagtaaagagactttgggccgttattagaggccttaatcagatacttcccgggtcgggtaagatcctcctatacgggtcgaatttagggtagatatttttaatttattttttaattgtttgacatgtgagaaacagagacaacccagaaaaaaaaaacagaggcttaagaaagcaagggtttttaagcgagggtttaaggcggcttcgtcgtgtacgcttcactcaccatttgtttttattttcttccgtctatgaaactcttcccaatttgccatttttctttgctcatgcgatcgaatttattcaatctcgagttggttattgttctggtttatcgattttactcaatttttaagttcgattg

SEQ ID NO: 4550 - DNA, 2000 bp, Arabidopsis thaliana
ccgcattgacatgttagttttttctcttacaaatatatatttgttatcttattctaatgttaaccaaacaaatattgatcgggaagaaaaagagatgctcagaaatattataacacaatgagtgattgagacatagaaaaaaggatgatcattgagattttgtaactatgtagataatatagacgtgcacgacaataataatacaactcggtcgatcgggtcaactaccccatgttataatttaatcgttgacataagaaactgttttaaataacaacaatccatggtttcttccccacccatatatagccataaaacacgttacatgaacactcaacacgttctattttcattttttattttgttaataatttaagaattttaagctgaagtccagattaatttccaaaacatagagagacaatataattattgccagctaagataatcacaattactgaatacgattaaaatccaagttggaagattttatttttgtaaccaatggactagtatccaagataatgttgatacatacgagtacattttatgtcactatatacaatttccgatattttttatttttcaatcattcgttaataaaaattctacaaacaaaaataattcatcaaaacactaaataaattttttttccctttttctcaattttatgccttgcctaatttctgttccattcatttttgaaacaatttcaatagtggaacatgataacaaaagtcgacacgtgacaagaacttaatagctggctggagattttaataggctcataaaatcataaaaacatagtcaacacttgtatccacagatccaccgttggattgacctttcgaaaatccagtggttcatataagagttaatgggaccacccggttaccgaggtcgtcaaatagctttatgttcaaagaaataatcgtaaattcgttattttttattttcttacaataatttagtagcactactactttaacattttaaatagtcagcttttcaccttcctttgtcgtattgatgaatcgctgttctagtggacttttaaaatcattagtcaaaccattactgctattttaattataatgactattattatttgttgttttcacaatatgtgtagaatacttaggtgaatttgaggttaataaagtttccaagtgaagactgtttctaaaatgaaaacttcttgttgtaaataagtaaacagtcaaattttatcaatagaaaaagacaaaaaagaagtaaaagtccggcgccaaatatttattggttatggaaaccccttaacttagtcttgaattagttaatcgtaaatctagttgacaaatattaaagtccgtagaatttgaaagaatacagaagattcaaattgggacaaacataatatataattaaagctttataaaagtcaaatgtatccattattattattttgggattaatcaatcatctctgtctctcgttgacaactcttccttctcttgcctcaaccaaattccagctggccctctttctccattgtgtgtgaatgaatcattgacattatttttacttactttggtcatgcaaacttctttctacaccttttgcttaagctaagttgaatgatttttgttaagagtgttgttatttagagaaaattctgtccatccattatctttttgggttgaaaaatatcttgaatttgaagtaacgataaaattcggatgccaggggtgggtcccagtaacctcgaactttgaggagaccaaactgttgattgctttattccgtggaaatcctcaactcaatcacagccgttggatcaaaacctccttcccggtttgactaaaaaatcaccaaaaatctgacccggtcacctcctcttttccccatatatcacgcatccttcttcttctctcttctccatcacaaccatttctctctctcgtcttcgtcttcttcttcttcaacgttcctctccaaaatcctcagaccaagaaatcatc

SEQ ID NO: 4551 - DNA, 2000 bp, Arabidopsis thaliana
ttgaaaataactcgagcctttaccagctgattaaactacccatatgattcaattttgatgttgtcaacttatcgctaaccctgtcattactttaatacattaaaattaaacaggtatttcaaatttgatatatgaaatatttcactcgattgaaaatttcagtttgaaaaaggatataattttgttttttttcttatttttattttttggcttatttctactggtttgtaatatacttcctctattctttaataattgattttctaaaaaaacacacatatcaaaaaatatattaaagctcattataaatatattactttttgtgatttatattttttataattttaaactaataatattagttatttattttaaaatttgatattcatcaattataactaattaatattgtataaaaatctaaaatattaatatttttgaaacaatttttttcaaagaaaatcaattaataagaaacagaaatattattttgatcccagaagttacagaggatagtgattaaatttttagttggtgcagtattttagattattaaaatataatattattagcgtggaacatatatatccatgagtactgctagttgacaaaactgtatccgttgaaattgtgatattaatttcatttgttcactagtgactagtgagtaaccaaagagatatgtatgatggtattgtatttgcatctaggtcttttgacaaggcacaatctaactttcctctgatgatatttactttttttagcaaaaagtaataatatttggtttagctagttttttattttagttattatatacttttttgacgacaattgtgagtatataataacagtcaagtattagtataaaaatactgactcctcttgtaagcaatttaacaaagtaaacgtttttttaacgtttccgttcatcataatactaaatagctcagatctgattgtgttacttgcaaatataatacgtttttgctttcagagctacagtatgttgtccacaacttcgcaaacatacttttaaataagagtctagaaacgcttgcaatttgttaaagagcgacctaattaataaataaacgtgagtttctagtaattactgatgtaattaaaatgatgcgtaattataaaaatatacacctgtttttctctagcattctcgaacggtatttaattttgccgatttgcatcgttcaattaactatatacaacaaagttgtttcctaattagactccatatataattggattatcaaacaaattcctcaattccaaaatgctttcaaaatttgtattcgaaaaataaatttacaaaatggtatcgatgttaaaattatgaattttgaatagaagctacaccattaaacaattttcatcaatggtttctcattgaaaaactgttcaatataaaaataaaatataatcaaaaaatatgaaaaagaatataattagtttctcaagtgagaaactttaaaaaacgcataaaaatacttgtatatcatctattgatcaaatattattttattattaaactttaattatataactaatatttattaaaatactaatattttttttttttgagaaaccatgaaggtattttactgatagagatgtttttagctaaagctttaacttctttttttgaaaaaacaaaagctcgaattaggcgaaaaaaaactagaaaagataaaaaagatttcaaagaattaaagattctatataatctttctcaatcaatttatgagacttctcgatcatatctattagcatggattatagtgatcttttgatatgattttctttacattttatatatgtgtatatatatatatatccccttaaataaatatgtcattaactcattatcttccctcactcgacatagttgactggtttcttgtcgccaagttttgctgcccaactataaatatgtgctgtgctcatgcactcttcaatataagtgttttgtgtaactaaaacaaaat

SEQ ID NO: 4552 - DNA, 1282 bp, Arabidopsis thaliana
ggattctttagatcttgtttcaattctttcttcttccaaaggcatttgtttgtttacggattgaatcgaagttttgatcaagaatgtgtatgcttccatgttttttaaacttttttggcatgggaccataaatttggttatgttttcttgtgtaaccttaattttcattgtgaaatgaatatttacattcttagcaaaaaaaaaaaaaaaaatatagagtcatttgatttttcttcttctatcccttaatgcatataaataaagttacaatgagctattatatttgcctaatccatctcgacaaagctctaagaagttgaatcctactactagcttttgtatttactccactgacaacaataacacgatagctatttgctattgatcatcatcatttcatatttcaaagcctttctgattcttctctaaccgaaataaccgggtactggtttcctcgggttagcttggataaccaaaaggatcatattcatatacgtaacatatgggctcatagacctttaggctcatagacctttagtaacaaaaaatttaaagcccacttcaaaatccagttcaaaattgttataagaataatccaattttccgtgaagaaaattaaacccataaatgtgactcggaaaatcaaggaaccaatgagaggcagagaacaaaagtgtggaacgttcattgaaaaccatatatatccatcatcacatgcaaaaagcgtataatctgttgataattttcaaataaaaatattaagtgtataacaaagtttttttgaaaaagaataaaataatgttattagacatagagagagagcgtgatgttctggatatgtctggatttctttaaactaaagcattgcttttttgtcagctcaaccttgactgtatttttccataatctgagaattattatgtttgaaaataaattatttaatttaagctaagctatacaaattcatacatagctctgttaataggaaaaatatatataagtgttaattttcaaatacgttttgcaccaaaagtctttccaccgtggaaaaagaaaacgcggttaaacataatttttgagttttgttatatttttagaaagttattgattaatatattcagtactctcactaaacagaggttgaaaaaggaaataaaaaaatgggctattaatattttcacaaacataaataaacccactagtccatctctctaaatcacaaattgcgcaacttacaacatctatagagagagagagagagagtttagttagagagaaaaaa

SEQ ID NO: 4553 - DNA, 2000 bp, Arabidopsis thaliana
tgaaccatttgatcatttagatgaaatatctgtggactgtggtagactcttcatcaaataatagattcaagttatttgatgtgcagaaaactcttcatcaaataacagattcatctttgaattagtcggacacttggccgaagactcagatttctagtgctaaaatctaaaaaacatatggattacatgattatagatttttgtatatataaatgaatacttcatcattacccgcacatatagattactaggaaacaaaactagtaagcgttacgtaatattttaaagagaactaaataaataactgaaacttgtgcgaaagactaattagactcgacactcgaggcatttagatggacccttggacctttaaaaagatttataaataaaaaactttgggaggcaactgaccttttagtgattaccgtgggatctaccaatgactatagaaaattaaaattaagaataaactgatgaaaacaaaagacaaaacacaagtgctcgtctctaaatacactgaaattctccatatctataaaataaacatttccttgtaaatatatggacgattgttattattactaaatagagcaaatgtcacatattgtgtcaaaatcatatgaaatttggacttaacgataacaaattaaaaaactaatgatgataaagaaatgttgtggcgccgcgtatgaattaggaatatattgataagtttcatggagatattgccaagtaaacttgctttgttgtccaaaaacctttgtgttgttcacgttcacgaagctctctcagccgccaatttttaaattacccaaaataccccaccaccatagagttaatccactgcgccacaccctgattcttttagcctgcaccaccacacgtcatcacgtggcgccatgtggttggaaaaatttagttaaaaacatgaataataatataaagtaaacctaaaggcatctccatcaaggagaaaccttttggtttctcaaacaaaaaaaatattagtattttactaaatttttattatataattaaatttttattttaatgaaaaaattgaaccaattgagataagagaaatataatgatggcttgtagagagtatctcatagtttctcacttgagaaactttctacactctctctctcttctctttttattatttttattatattagtagtgagaaactcttttgagagattaccaatggagatgatctaagtattttataaaaggttcttatccaaaaaaaaaagtattttataaaaggttcagaaaaatacaaaatgaatcttaacttataactattttacaattcggccatataatttgttaaaacttctaaccttaacaaattttactgagtaaagtgcaaatgattttacaaagaattaaaaacaattttgccacaaattttagtttgaaattagtgctattgcgatgagtttttgaatttttgatactaagaataattaaggtatataataaacactttacagacaaaaaatatcaaataaataaccacaacagatttctgatacatttctatataggcacaataccatatacattataatctttgtattttagtcataagtaacacaaaataaattgtttacatggtagttggcaatcatttgctaagaacaaccgacaacaaaataatcacacaagacaaaatgcagacaattctcaaatccacaaaaaaaaaactatagacgttatctattgataattggaatctttaacataaaccactatgattaggacttaaatgttagttttaacaacttgggtattattacttgatgattacaaagattaaggacttatttgactattttgacaagttgtcctacgctcttaaaaacccgttcgcttcctcacagtagaatctctccacaccggattatccaatattctccacgtccgcttcttccttcaactgagtccgactaagttgactcgttctctcgtgttttcgatagacacaaact

SEQ ID NO: 4554 - DNA, 234 bp, Arabidopsis thaliana
cagaaagaaaaaaaagtcgccggaataaacacggatttgttttttaagcttaaaatatcaaattgggctttagttccttaatgggccttattttggtccaaatccagttacgtggcaaagagaattagggctctttgttcttcttatttaaaaaagttacgcctttcttcttcttcttcttcttcttcttcttcttcttcttcatttctaggattcgaaacaacaatcaacgcg

SEQ ID NO: 4555 - DNA, 2000 bp, Arabidopsis thaliana
agctgcgaatcctgggcaacgatgacttagtatgtatagaagaaaaaaaaagcttttacttggtatcaaacagagcatgtgttgttgtatttgctacctttttctgcaaagttattggcaattgtattgttgttccacttgtatatatacagagaccatttatgttaatatacaacttcgtatggggaaagatgattccatcaagtccaaaatgccaaaaccatgcacgatcttgtctgatcaagtatgataagatgtgagattttaagaacgtgaagcttttcatattgtattctcaatgaacgaagaattaataattagagttagaaatgcagattacagagattacacaatttgatctcatttcttggcaaagaggcccaggccaccgaagccaccgtccttctttggattcctgtgtgttaattttcgtgtggctttagttacaaagggattatattgtcagcgaatctgagccgttggatcgttttgacatgagctttccataagtgtcttatcctttgtttctctcatttttcacatatgtatcagacatttaatcaagcacatatctacgtgttgattatgttgatgatgctgagattatgttgatttagagaatgagtattggtgatgatggtacacgttagtaaacatatgaatttggaagtgccacgtgagagggagcagagttttgggctttcttttggttatgtatttgcattcttgttgtaacaaattctcttattaaaagcattgtgaaaaaaaccaaataccacatagtctatgtttcaagatttgttttttaatactataattttctattactttagtttgtgtaatttttgaaaagagaaaattggtattttttaggattgggtgatctgaaatttgactacaaaaattttcttggacacagacacacagtcacacaaataagctaattattggaattttatcttaagttgcattcactttgcaaattaatattgaattatagactattagtgtatggcgtgatggcaaacaaaaaaatcagtgtgtgatattgtggactagccaaaaaaattttctgatgatttttttgcctaaataatttgaattgttgagaccgaaactcttactaatatactaacaatgtaacgcgacaaataaaacattgttgagaataaaatctgaaccatcataactatagtctatagtaaccgtccgaattcaaccacatatgtatgatctttgccatttttgatcatattttccgttgcgttttctttgaattttctcaatatatttttagtgttttgatttgtacttttatctaatttatataattgtttttcaaatgtttcgcaattgtgcgtttaagtattcgactcgaagtaaacccagtttcttagaatgggctaactgccattgaccaaatctttatccgcgaagaaagatctttagcagctaggcttatttcatatcaacaaaagtatatatttatctctaactaaattcctacaattatttcaaaaacatagaaattaaaatttgaaatgcctattcttttttggttatacattgcaaaggttatgtatgtaatttctgatcttgaaatttaagttctttagcccatatctagttgattttcacgaaatattgtcgtttactctcgtttttatatataaagcatgtacatataacatataatcaatgcttcaaaagaaaaaaataatcataactaaattgaaacgggaaaactaatttgctttcgtgttctattatgccaaactgtactcacaatagtcttatcctatcgacccaaatttaatcttcccaactacttactcctaattgaaacaaaatataacctttcttactatagcctatatttaaaaaatatctatgatttctacatttatatatatacgcacacggcacatacctctcattcaccatatatgcctcttaacaatctctccacagaacaaaagcaaaaagcctaaaccgggata

SEQ ID NO: 4556 - DNA, 1965 bp, Arabidopsis thaliana
ctgatgaacaaaagcaagttaagctttttggtctttgatgatttcttatggaggaaaaatgtttatatattgattcaagtggaacatgaatcagatatgcatatatctttatacatgtgttaagtatatatatgtaagttcatttattcatttccccttgttctgtctgtacaaccaaaggcctacacaagagttcttgtaatcgacacgtgagttttacgatttcgatcattggagtagctcaacggaagaacattagtagcacagggtcaccttcgtatttcttttgatattttctcgttgtagggttaaatcatgtgcatcttccttacccttgatgaatctggatatggcgtttctctaatagaattgcgattatcatcatcttagatacagtttgtgcctaacaaatccaacctaagctagttacttaatcattttcttttggggaagtgaaaatggcatttgatttcaggataattcttaaccaaagctgctaagtgaagaacttgtgtcagtgtgcattccatttcccaagtgatgaggaaatcttcaaaagtgttcatgtctagagtgtaagagggcactcgaacacagtggttcgccgtttcctccattatatatacctctactttgccccttttagttttacttgtcacaaaactttccagatacatatttactgcacaaaaactaaattattttgagtaaaaattaccaacgcaccagcaggttatttttttttattttttttacggtgtattgaagaaaatttcaaaactacataatcgtaaataagagttttattaaattttacacaattagatgcattttttcatctgatccaactttctatatctcttcttttttgtgaaactgtatttttagaaaaataatgtgtttttgacggaaaatttggtggattgatttgggttaaccccttttgacaccccttagttccactaatagtttttttatcctacacataaatttctataaacttttgtaatcagatatagtcacatacatatggtagtaagaattaactaataggctatatctgaaaatggaaaatggaaaccgtctttttaataatgagctcaacaagaggattttctagatgcttgatataatcgaaatattgaatacacctaatggcttcagaaaatataatattgtttctagttctcataatgtatgttcttggaagcccaaaaagaaaattaaaaaagatcttctccatgatctcctctttaattattgtaaatgaggtattatacgcgcaatgtcattcacgacgcacgcataaccatttgactctttgattgcgttatacttaacattaagctatagttaaatgtttagtttcgagtgttttgattggataattttaatttgcttggttcctgttcggattagtttgtgtgtttttaacctttatagattgtgttatataccttttaatctcttaaataaagcaaacaaaaaacagtaataatacataatggttagttattcgggtaataaacaaaaatatgtgacatttgagtcaataagaaccagccactgcccgcagaccacagcaagtcttttgtttttgtttttttttgggtcaaaaatattagttaagtctattcacgttttatttaagttataaagaacaaataattggaaaaaggtagtgtttcacgagatcgaatattttcttgttttttgtgcaagtctgtaatcagactaaaatatcattaatttcatcgtatgttcttaaagtattaaaatattgatcgtagcatgtggaaaatgttgattattattcttattttaaggtcttcattttttgtagtcttgcgacgacccttgactttaaatcctttataaaggcctcgactaaaatgagatgtaccaacaacacaaaacttgtactcacaactaaaagaagaactcaaacgcaagacagaaagatca

SEQ ID NO: 4557 - DNA, 422 bp, Arabidopsis thaliana
taaagaaaactttaaacgttggcctacggcacttgattttttatgtaatatcaaggggcatatttacagtttataataattcttacatagtatagtaataaacgtaatttataatattcaaagtgaaaatgaaaactcccatgaccacttagataagttggttagccgttaaaacgaagaaacacaaaaatcacgtttgtaactacttggaatttttttttgccatgagtaactaactaaaatctagtccgaatgtttcctagtatttaaagcaagtctggtttcaagacaacttcatcaatacaaacttagtagtgtattctttatacgtataataacatcccttgtgatcaaacaagtaaaccattcaaaagatgaaaggaagaattttgattttgagtttgctcataatgagtctggtc

SEQ ID NO: 4558 - DNA, 2000 bp, Arabidopsis thaliana
aattttttttttgcgggaaatagatttacaagggattttaaaagggttttaaaagatttacaatggattttaaaaggttttaaaaaattttacaagagtttttaaagaatcttcttgtaaactctttaaaaatcttttaaaaacccttgtacatatcttaaaacccttttaaaatctcttgtaaatctttaaaacccttttaaaatcccttgtaaatcttttaaaacccttttaaaatcccttgtaaatcttttaacacccttttaaaatcacttgtaaatattttaaaacacttttcaaacaattttgaaccctttaaaaatctttataaaacctttgtaaatcttttaaagccctttaaaatctcttataaatcttttaaaacccttttaaaatcccctgtaaaacttttaaaacccttttaaaatcccttgtaaatctttttaaacccttttaaaatccttgtaaatattttaaaatcccgtgtaattcttttaaaactcttttaaaatctcgtgtaaatttggcgggaaaaatatttttggaaaaaaaaaattggcgggaaattgttttttcaaaattatttggtgggaaatttattttggaatattttaggcgaaaaatattaatatttcattttgtttacctaaaacaatttccaaataacggtaaatggtcattaaaatttaaagaaggtaaaaataaaaatgacaaataggaaagagtagaattgaaaaagggtaatgtgaaaagggtattctcaacaattattcaagataaaaattgtataggtgttaaataataatgtgtaaaagagaagacgatgtgaagtattaaaagaaaaaaaaaatggatgttgtatataagtaaccattgtagatagtttaagcaagaaaaattgatgttgcattggaaattaaaaaatttcaataaaattagaaaagcaactctaaatcattacttattttattattttcaagaagttataaagtattaaacaattcgttgacaaataagtttgatcgacattgtgtgacaaatttaaaacacatcattaataacaacgaggacaaatacagttcagatatcgtctactattaaaacacttcttctataggagcaaagaaaaattgtcggcaacgaactggggaccaataatattccgagtttgagttcaaactgagtaattttattttgagaaaatttgccaagttaacttataattctggtttacgtgtagtaatttattaagttgttataggaaaatgagaaaatactaagacacatccaagaaagtttcacacgaaatttacttacaaaaagattgtttatttaatacttccgtatatagatatataaatatttaacacattaattataaagttcaagataattgattatctatctttttttgtcatctgaaattattatcgctcaaacgaagtaattctgaggaaagttgtttacaaactagttatttcattattgtctacttatataatagaattaaaaaaaattattgcttaatgcaatttagttttagataaaatcattaaacttaatagattatataagttagatatcaataattgggcttgcttaaaaacataaatataaaatattattgggccgttacgtgcatacaaaacgaaccttctaacaaacaagtgtgaacgttacgacttcaaaattaaaaaaaaacacaacaactatgtccacacgtaatctcatatgattcagattccaaggagaacaaaattaaaaacaaatctcgtaaacatacatacacttcacataaaacaaaaggtacagtatataccataaatctccgagattcttttgatgtatctgtccatttcattattacacaaactaggaaactgatatctctctattcacattcctctgattctatttctctttatatatattcacccattaaccatctcaatcttataaccctcaaaatcacaatcttctcttacaaaaaactttgaaag

SEQ ID NO: 4559 - DNA, 2000 bp, Arabidopsis thaliana
cgatacctcttcctctctctaataacaaatcaacgtttttttgttttttgagtatttacgtttatatcctcgtagtcctctcatattttcagattaacctcaagggttttatatgggccactcattcttatgtaatctctccctttcttaatcgattttttaaatcttttactgggcattaccgatcaagcccgattataataaacccaaatagaataattagtaatctggtttggtgtatatttcaaattagaacaaacaaaaacaaaaagcaaaaagtttcattaaaccgaaccaaatggttgtaaatcataagaattgaatgcctaacctaaagcaaagcaatgcctcattttgcaccaaattagatggaaactagcttatgatatctcaaaattagtttgttcctagcaagttgatgaagcaacttgtgagctatttccactacgatttcgttctcttgagtgttttggttgtaattaattttgattaggtctaaaatcttcgtgtcacatgttctgcatgtacaactgtatttttcttgagaaaaaaagccattgcacaaacttcagttcaaaacattttgtgtttcttctatcaattattactatatagaaaaagtttctctcttgatatttgagtttaaaatctggtaatcatcaatgaatattgtcaacagttgttaaaatcagcaactttactaaatatgaacagagaatgcaaatggtggaagtttcacattatattggcaagtgtagaaaaatgtctgaaagtatatgggcgactgggagttatcattcattaagaaaacaaagaaatctagatcgttaaattctacggttaagaaagactttttattatggtaaagaaaaatagtcaaataaccaaagtaagcaattaatatagtttgatcaatgagttcaaaagcctttggttggaataactcattaagaaaacagatagtttaaaatcaattgaattatgatttcagacatagtataagtttgggcaaagtattttaatggaaatagaatacaaacttgataacaagttattgccatttagaaaatgttataactccttatatagtgagaaccctattgcttgcttgtgttcaaggaattgctgtttatggaactccactttaaataaacatataaataatctatttagtatcaaaaacttaatatcccatctactttgaatttgcccgatcatgaaaacacctatttattgtacataaatatacatctttaacaaatatagatctatgcgtgatctatttgtatttgtatcttattaccttttattcatatagaaaaaggaaaaaacaaacaaaaagctttgttccaagagtttaaagtatatcaaaattggcaaaattgtggggttttgaagtaatctactagattattcattttcttgcaaaaaacacctttttatagaattgcttaccgaaccaagccgtggacttcactttcttaaaacatgaaattacatattaaaggaatcttttgattaatcaaagaagatgtttgtatacatagataataaatgaaagtggaaatatttttttaaaataaaaataaaaaaaataaagaaactccaatacgaggaattgtttcgaatataatcttttttccaaagaaagcaagtggttagagagagaataatattattttattaaatttttacaaaaaaaacagtgacaagagaagagagagagagaaagggcagtggaagtaaatataaaggaaaggataaaaatgaaagctttcgtagaagcaatctatcaaatttttattttattttcttctctctctctctttagctcttttttttttgttttcattaaagtttttattttattttctaccaaccaaaagcttttctctttggtttctcttatttagcttctaaccttgaggagaatcataccagaggattgaagtttgaaccttcaaagatcaaaatcaagaaaccaaaaaaaaacaaaaaaa

SEQ ID NO: 4560 - DNA, 2000 bp, Arabidopsis thaliana
gcatcaatctatatgttgcatgttgtaaggtcacaacttggaaccataaaagaatggtggaggatagcaagtgcgtagaagataaggatcattttacatgataatctggataagacatgcgcatatacatcaagtttccatcaacaagatttatagtacccaaaagaaagaaagaaaaaaactaatattccatcgatctatagaagttgaacaaaataactaaggtaccaagtgaaatatgagtcagcaagcaaagttaaaaaaaaagttgtgtgagacatatcacatgagtaaattaacaacaaccatcatcatcatgatgtagatagtataagatgccatgagaagaagtgaggaaaaacaaattaacctgacaagaagcatcctaaaaaattaacctgtcaaacaattaccaacctttaaagtgaaaaaaaaagttgaaaacactaaggctttgagagcttaaatgttcataaacaattttcctttttcttgccaagatcaatctgcaatttttgtgtcaagcatgtacgagttattgttataaataaatctagagtcgttatgtgagttctactgtattttatgaaaatcgattaactagtaaaatacatcagtcttcttaagaagagaacctaaacacgaaaccctctaataaatgctagattgcatattcttacacatctatattagtgtcaaaaacatgattggactgattttatagtattgaacaagaacgtgactaaattttcagaaattggaaagaaaacaaaaacatgatatatttcaatatctaaatttcaccatatatatataaaaagacatagtgcatgtgagacgtaaaaacctttgtaaataaattttctctttaaatagtaaatagtaccatatcagattaaccatttcagagtgacataatttgtttgtaaccgtatagatccgttttatgcattaaaacgatcgtgaagtagctgtcatacgaaagaacttgtcggcaagagaagcaaagcataagcagaaaaaaacatatcttttagaagcctatcattttcttacttttattcacaaacacacacaatatacattataagtgttatctacataatctaaacgtgtcaatacctgaaaaaacaacaaaactttatttgcacttctttcatttcatgaacaatacataaccagatattagataggacttggacttgtgaatatgctctatttaaggcatctttataggttatatttagaatctttttcttatttcttttttgagcatattattaaactatggactagatctgatgaaagaaagcaatctatttatatattatggtgtaaatattatctttaaaaaatccaatggaggagagtgaaagagaaaagttgaagcattttgtttggactatagagagagagaaaaaaagatcttaactctccttagaaaagtactaggaatcaatttttattttctgcaaaaacaaaagtgtaaaagaaaattaataataatatatattccctgatgaagtaagactaaaataatgtaactacacaaaaatactttttagaatttataatattttatattaatttttaaaaaaggaaagttgataagattggatataagtttggaagcatttatttggccaagaatggcttagcatctctgcaaaaccaacacaaagctatattctcttaaaaatcagttcaacaaaagaagaacctgaacacagttggcccaccaccaccactaccacaatctcctcctccaccaccaccacctagtcaccggaaaccaattcatgccctagattaagaaccagaatccttttgagacaagatctatatatacactctacacatttacttatacactttatctagatatagatgtgtgtgtgtataaaggttctttttcattacttgttggtttagtgataaaaaggaggagagttttcagttgggttttggtttcttggtgagagaagagagaaaaagagagg

SEQ ID NO: 4561 - DNA, 329 bp, Arabidopsis thaliana
gatagatcatagagtctcaatatgtttcagaaggttttttgtttgatgtcatattgagaacaatgcctatatactactctccatttgtattaacacttgagtatctgtaaccaacgaagctcagatgtgatcgatattatttttttaacagtataaaaccacttaacacttatttagtttgttgacctcgtggcttcatattgactacagaatgaaataggtaaactataaagtctacactatttatggctgaaatttatttgaatacatatccaccacttgtcttgttcttgaaacacacggtcgtggccatgtctgttctgcttccg

SEQ ID NO: 4562 - DNA, 2000 bp, Arabidopsis thaliana
acccggttagtggttaatacttttactatatgatacttaattacttaccgatagcattgacagattaaaaaatacacaaaagctttgtcaaacaaagagatttgaaagacgaatcaaatctctctacatacagggaaaattatgaatagctacatgtcaccatctgtttaaagtaagatccaatgttctcatctgtatcttttgactatgattgatgactatgtgacctatatcatataaatacaacgtggtaaattgttatactcattaagctaccatagtccataatacactttaatttcccaattcacgatttcacattactcactaatctaacattttatgatcaatctattgagtattgaggattgatgaaacaaagaacgaaggtatacttaaatggagatgtcatataactcagaaagaacttcacatatacatttattaaaggaaaattagttttcttatgaaaataattagccattaattagaaactgaaaactcttaattagctttttcccatttttgtgtcggccatatgtaacgttggacccatcaactaggtcacaattggcatacgacaaatatacataactttaaaccattagatcttttctctttcattacaagctaaagtaattcaaatttagctaaataaatttaaactaaaactttggaaatgtggtttagattgttatcaaaagcttaagtgggtttgatcttgccgatgtggcttccaaaagaaaagtattaattggttgaagaaagtgacttttgtcatgcaacctagttgtatgtcatgatgtgaaattaagtgggaaaccaaaattcatattgacaaatccactaaactctttagatgataaagtagaagagcgtgtggaagtttcaaatatcatttcctttaagattacacaacaagagaaaggttgatccatcataaagacgaaatattctttaagtcatatacatggtctacaatttctcactaagatacaaagtaaaatcgataaatataataatgaacgtacgagtggtttccaagttgttctaaccaggtgctttgtcaagatcatcgatctatattcttacccgaaatacttacttaactattattacaaagttcgaataaccagttcttttactttgtgattagtttgagctttggtttgactcaatagaagacaaaagaaagaatagatgaaggagaggaccacacgagaagccaaaggagacagaaatggtcacttacctcgtggagttatacaaaagtagacataaacagacctgaacaaatttggatggtccatgaacagtactcttccttttcaatttttattgtcatctttctcttctgtcatttcatcatgatgtacttactattttgagaaactgcttcgttttccattgtcttttcgatcccttaacttcttttagaaaatgttcatacttaaaatattaaaggattccttaacatgcactacaaaaaaaaaattattatggattgtggattaccaatggtatagtactcatttggtttacttagatatttggtcattcataaactgaaaatctagaaacccaaataaatctgaaccggaatcaaagcgaaatttaaattctacacacttaatgtatttgttggactattgaaggaggaagcagccaaaaagggtaagagtcatatatatagatagaggtatttagatggtggagttccaatcaactagctttaaagtgttttgtgagaagggtgtgacagcaaaccaaacctacctatcgctctcatcatagtactttggtccacttattacaaaaccctaagaaaatgttctagtgtagggtctttgtttcctttgtctattcctttctaataccatctacttctgctcccattcactgatataaacctcttctcatagctattattgatagaaagagacagagaaagagaaagaaaaaaatcatctcctgaaaaaatctatccctttttagctctc

SEQ ID NO: 4563 - DNA, 509 bp, Arabidopsis thaliana
attcctctactcagacaagaacaacctcaaactagaaaaagcatgcgcaaagtcagtcgagtaaaatccaatccttgtgtatcttcaatctttaaacagttttcttgtttgtaactcttatcttgagtgtgtcaacaaatctaaaaaccttttggcctctttactattttcaaattttcttgaaatcacttctcattcattcttcaaaaaacaaagctggatctctcccttttgagattactccaaacactccaacaatgtattgttaatttaataaaagcttttcaaagtcataattttgattctgaacggttctgcatcaatgtgaaacgtcgtcgtttgtgtgacccagaggtttagagggtccactcgatctcttcacctttcctttgtgaggaaaaaaactctgaactgttgatattttcttcgtcgacactaaaaccctaaaaaaccctaaaaaacccatctctttgtctctctttcttctctgaaagcagaggaagtaaaca

SEQ ID NO: 4564 - DNA, 726 bp, Arabidopsis thaliana
cggagaagccggcgacgaagataggcttgagccgtcgtcggaggccaacggtggtgtaataatggaggatgctcacgcgcaacacacgtgttctctaaccattgagataacaaggggtataaatgtcttttccaaataaactcaaggattaagttaatttcggagaagagaaatttcgtgcttattgggcctggactgaacatgctgttaatgacatgttgtactgttttagattggagctttttggatttcgttatcccacatttaattattgtagaacctttattttttgactacaaaaaaaatatattcttcgctctcataaaataaagaaaatataattgaatttatttatgattcatattcgtataaaaaacatttggctacaagtatcatgtacaaaacattcggctagatttagttagaacaagatttgttataaatcataatggcaatataagagattagagcaagaaacatagcaattattatttgagaccagttttgccccatttcttacgatgataaacgactttgaatattcttcagtccactccacactgcgacgacgacttgagaaaaacaacatagagaaaaaaagaaaaatccaaaccttaggggcaatattgtaactaaaccaaacgacactgagtcaacattctgctttgctataaaggcccaagcacaatttttcagtaaccatgatgaagtgagaaattctgaaaa

SEQ ID NO: 4565 - DNA, 438 bp, Arabidopsis thaliana
agagtggaaaatagtagtttgtgtatagctcgctgctaacattttccctctcaatttttaattacaaacgaaataagttcaaaacattcctctgatttgatctgtaacaagtctttcttttattgatatctcagcaataaaattctcttataccaatcatattttttgtcaatagttacagattcatagaatatgtatgatataaggatgagagttttgatttgaactctttttcttctacaactttaaataaaacacattggaaatgagtcttaactatactaacaccgcagacaaaactagtaccacctaacacaaacgctgtcgttttcaagctacatttatatatctcccaccaactctttctcagatcttttgtctaagtaaaagcgaaaagggcaacaaacaaaaataaactcggagaatctcacaacaatc

SEQ ID NO: 4566 - DNA, 2000 bp, Arabidopsis thaliana
ctaaacaaacaatgttttctaaaaatggtatgcccaaaaatggtttacgaaaaatagactcaaaaatacaaatgtcattggcgaaaaataaatgacaattaatgaatatacaaataatagataaaaagcaaaatgaaataaattttcaatgtttcatttagttaaagatagtgtatcttgaagatcataacgtattttagattatgtacctgatttataagtggcttataaatcacctaccattttaccagtaaccgatctaatctacacacaaatatcatcttttactcttataagattttaaccatatttttagatctcataagaatcaatgcaatttcatataaaacatcaaaataattctataaattaaaattttctcaagataatatttaattttatttataaatctcttaattagccatctttctacatttatcaaaagatattagctatctgttctcataggcaatatgataaaaaaaaaaactttttccaagttaggggcacaaaaagagtttccctgggacttgggctgagaataatgaagtggctgggaaatgattagttaaggatggcttgatgaattctcaatattctgttgagggaacaaaatatactaggaaggatgcaagtccagtttggtctaaaccattgtacgaaccaaaaacaatcaataaagtaactcagggctcacaaatggtcgataatatttctaaagtttcagttctagaggatgagcaaaaggatttgatgatgggagatgtactagaggtacaagacaagagtctcactgaagggttgaatttcagatattttaaatcacgtttggagtaacaaaaaacaaatgtgagaaggagctcaattagctccaactgaatctagtgttattagggatactttggaaactccaattcaatctttaagatgtaggattgatgaattcatggaaatcggcagatccatctatgaatttagtatggtggtgtttcctaggaattgacaatacaattttacttggtgcaaagtgtcttcggaggtgtccctttctttttcactcggaattggaagttttaatattggcaataaaaaatatcctttcaagaaggataaagtgtcaggcatttgaaacagataattattcagagtaagttttgatggtacagtcccctgaagaatgactcgctttctctaattttttagaagatcttgaattgctatgtgtctccttttcttgctttcttctatttcatgtttatgtaatactaaggcaaactatttagcacaatattctaaacttttattttctgaagttattttttaaaccctttccctcctaattggacaaccaatcatggaattagtttttacgtaatgttttaaactcactatttcacctttattctgacctgttaatggaagacaactatgactttatacattgaaatgttgtcaacctgttatatattaatgttaacatagctaatgacctatcaatgtacgtaaagcgaatgtcaatcatattcgtatccgttaatttcatttaggaaatcaggctcattgccaatccactaagaaacatctctgatagatccaaataataaaaataatataatatgaagcaaaatagaacgaaatatctcacgcggaccaaactttgaactttattataaaacaaatcagcacgtgaaagtaatggtcggttcggtccaagatgccaagaactcctccggtccatccatcaacctaaccttttttggatataaaatttagcaaattccatttccacgaccacacaacaacaacacatccactcgaattttctatttccgaataacaaaaccggtaaactcatcacaaacttaagttactttgtagtttgtgttttgtccttttatgtaatgaagaagatccaactaactactactcaatatttttgtattgaccgttgatttctcagatctgacttttacttctccttcttccagatcggcggagac

SEQ ID NO: 4567 - DNA, 2000 bp, Arabidopsis thaliana
tgataagtcacataaaaattgaatttgttccatgtctgtatagagaagaaaaggagttttcatattttccccatttttgttggggtgaacaaattaaaagttatctgctagttgacatgcataaaggttagaggaaaaagaaaaggaaaaaagaaaaaagtttgtcaaaatattttgcttcataagtttgtgacttattcagagttatgtttctaaagatgtgataggtacagcaaaattgtatttgttccaaatgtcaattagtgaagaaaagaaaaagagttgtcatatttgttggagtactgaaagataatcatgtggcaaaaaaaaaacgaaataggaagaatttcagtaaaaattatgctagcttcacatgtatcaaatatatttgaaccaaagtatgccatattcatgaattgtttttacaacaatttttatttgttttaaactctagaggctatatgtgaaaaaaaattttacagcaaaaataagattatatcagaaacattacagaccgaaatttacagccacgatctaaccaaacatctactaaattgacataatagcattattcaaatatttatttggaaattggttgatgtttttgaaagttgtggagtatcccaaaaatccaatgttgctcaaaagttcagtttctctaataaattcaacacctagatggaatctataattggttgactttttttttttttttttttttacagttatatacctgaaaaaatattccaacttgaaatattataaagagttgatttttgtcctaaccggccaagactttaatattttatactgtctttctttgctatcctttgtttgtttgttgagacaagaacgaaaaccgtgcattgaacaggcttcttcataatttaattgcggtttatccttaaatgatttgaaaaatggaaatgcatttatcaaaaataaaagaaaataattgaaatgctattatattccagagttggtttgttatttgaaaattatgctggtttaagtttatatttgaaattaattttggccgtttttctacaaaacatatttatcatattggagtactttttaaatacactaacataaaaatgttgagaaaaacttttgttaaaattctagcttgtgacaactaaaccagttgacatctacagttgtaataagccgattgcaaattaattcctaacattttaataaacaagaatatatgtggatctaaattcaaaaatataaacagtacactaacatttgtacgtctaatatcgtagtaaacttttacttatgaacacctttttaatacggtctgatcgatttatttatttatataaccaaaactcatatatattcataaactaaattatatagtaacaggatatattatgagcttaatatacatgctatatgcctatataaggtcttaataaccaaaactcataataatgtattcataaactaaattatatagtaatatttttggtatattttataactttaaaaaactctaaatatttgtggtatttttgaaaatggataaaaatgatatttttggaaagtagtataattttaaaaaacttctcccaataaagacatgaccaaaaatgtgtgttatttctatatatatttttttttttttttgatcaacatatactcttgtttctaatctgcattccctccaccacaaaaaaaaattcaaatgataaaatataaagaagaacaatgtggaaatataattgtcatgcaacacgacaaattaatcattcgagtaacataatttatacatataatatacaggtcatgcatgacattacaagacgtaactgaataaactaatatcaaccaactatcaagagtacatttctttaaatttgttttaattgatttcttaacttattatgttaattaatacagtttatttcatactcactctattatataaactcattttgtctctctttcgttgtcaacaacttttcttcattgacaaaaacacacaa

SEQ ID NO: 4568 - DNA, 2000 bp, Arabidopsis thaliana
ataagttattttctaaaattgaaatatctgaagtctgatcgatttcggacttatagctagtcccagaaacattcagtttatatatatggtcagaaaaagaaactagactaaaacaggaaaaaaaaaatgtcgtcgtcgtcgtctctaataattaagttgaatttggcttagctgaatgtttctggcgttgtccaaatgtgggtgcccaacaggcaacgctcacgtggttctttctcaataccccaacatttatatgtataagttatcctcttcttcttaatatacttatgcttcttaatacgcgtgggttagtttatttgtgtcaccaaaatatttttgaaaacgagactagctagggataaaacgtctttgtggatgaataatgaagttaacatatataagaaaccatgggattttaacaaaaaaaaaaaaaaaaaacatggatcccgtgacagtctgcgcgcgcgcgcgcagcatagtagaggccaagagcgaatgttatttgattcacttttgtttggttcttttgtcaacattcactctttatttcgatactcttgcttccgtatcatggatttttttattacgttgacaactagaatatatgttttattttttttgaaaaagatactatatgttttatcgttcaaaaaagatgagtcaagtactacaatttacctatcattttttttttttgttaaaccataactttcaaattgatccaatgtttcaggacacttactttcaaagtttatcaacacctattgcattttattttcttaagatattaaattttctgtaattgtttatctaaagcatggttagtattctgattttttgacaaaaggaaaataacgacaacatcactaatatttcaacgttccttttttttcctccacaaaattcaacgtttcattttacgcgcacagatttttattttttctatgtatattttgtaacgatttttttaaaaaaatatttgtaatagttattagtatatgctaaatattgaatacaattaatttgctaatttcctttgtagttggtcatgacatgatatctattggtttatgctagttttattgttattcaattttaaactcaaataatgcatattattgatgaaaagatatactacaatattaaacaaaagttaacatagttactgaggaaaatggaatacggagaaattaagaaatgatatattatgtgctatattattattagtcgcaatgatatctttataataaaacacctattaaagaatatttgtcgtttccagttacatctaagatatataatatatatttttttcctagcataaattcccggaaacagcatgtgatgaaggaatatatcttgaagtttatagttgttgaccaaaaaaaacattaattctattatttctatagttataaatttagttagagtatgaaaaacaacaccatcttattcatgataaacacaagacgtataaacacgacaaaaattctttaagaagagttttatttcgatatgattcaaaaagtttcaaaagctgttatagttcgatttcggtgtgttatccatataactaaaaagttggacagctttcattgaaatatactactcaaagaataagaaattactagatttattatgttgtctcatcatgtttatgacttatatgagtatcaacgtggatgaaagtggtcgcttcttcctcatcggaaatcaaaataccgcatgttcatacaaatcaagaaaattataatttacaaatattgtaaagagctaattattttataaacataggatatcaaatgtggacctaaaaaagtttgaaaatgcaccactcaaataattaatgcatacagccaagcaagtaaaacattagaaagacaaaaaataaatacttttaaacaatttatattatatagtttttcatctcaaaactcaacaatataaaccctattccaccatcttctattccctcacaaacaacaacattgttaagaata

SEQ ID NO: 4569 - DNA, 2000 bp, Arabidopsis thaliana
ggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaagaatcgaatatttattatttcgccccgaagattctatttctgatcatttacacccctaaaaagagtagagctttcgtgaagccacc

SEQ ID NO: 4570 - DNA, 1910 bp, Arabidopsis thaliana
ggagatagatttgtgaattgtaggataattgagtacttttgtatcaaagaacataataatgatgttggtgtgtgatgtctgatgtttatgtagatgacatatataataaggtgaggagggccacgacttgtaacatgttgactaggtacattacatacacgcttggatatggtcattggtcagagttggagaaagaaaattagctgctttatcttcccttttcccgtttctttacatttttgttttggcaatactctttgaccaattctttttgaattttccatgcttgtttttatgttaaagttctttttaatattaaattacaaagacatcgatcttgttaatggaagtcaaacatgttcatgaaatgttaaatggtggatgaggtttacctatacagattctcgtgaacatgttctattggacttttataatatatatggaccagaggtgaatatgaatatgaatatgtaagttgagtctagtgcggacagagctttacaatctaagccacaaaacaaaagaaagcaaaaatcggaccatgtcacgatgtgcttaaatatgtgaggtttttgcatttttcaggccaagtcaagtcaactagccgcctgattaacttctacacgaacaaaaaaatgtaatccaatggtttgtgttagtgttgtcagtgtgtcatcacccttatggccttattcaaacccgcatattgcatgttgctaaccaaaatataaatagtaagaaagttaacatgatcttgtaatatatgagtatactgatttgtattataagtcccatcgtggtgtcattaatcgaacacagagccgtctctagtatttaatagattgcaagcaaagaacaaaatttagacctattttaatgagtgaaaatgaaaaaataacaaggtaaatgaaggtagatggactcaaacttttgacgaccataggtatctaagaatcaaataatcaacgtttttactgaaagttataaaaaaattaggtcaatattttatttgtagtaattgaggccgcaagcataaatttggtcctattgcgttcatggacggctctgatcggacataaatacggtataaaattttttaaaaataaaagtcaataaacaagataaatcttagtatttattcggtataaaataaaaatctttgcatattaaataaatatttgaatatgtatttgaattataggatcttgtaaaataatgattgttatatgtctagttaacagttttatcggttagaccggctggtcaagtatggatctaaagacactgttcttttctatgtagcttgtgtatttaataaattaaagagttggcggactaatattaacctaactaatgttgtttgcacaacttaaagagttagtgaactaatttaactactcatgtcggtctcttatggaatgtgtccatgagtaatgctaaagcagagatctcaatcaatcatgcttcaaaaataaagttcatagattcaaaagccatgacaagatatctaaaaaatcatacgaacagttgtaagtgtgtaagcactaaaaaaaggttgttaatattaatcaagtggagacaaggaaaccaaaattgatttagccaatagctgcgaaagaacaaaatggtaattacgtccaaggacaaacagttacaattatcattttcagcaagaaagtcacacattcattcatacacatttgtctcgtctgcatttaataacattgacaccaaaatggttgggaagattacccaatttaaagacttcggtggcaaagcacgtctaataaatatacagttgggttcccttctattaattactcaacactcacttctatatcacagttttctactaactctttccttattcttgtaccatcctaaatcagtaagtccttaacgtacgcacc

SEQ ID NO: 4571 - DNA, 2000 bp, Arabidopsis thaliana
gaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctccatggaaatagagcaaagaaggatc

SEQ ID NO: 4572 - DNA, 1259 bp, Arabidopsis thaliana
tatacatgtatttgacgctcctccttgttttttgtttcggggtgaaggactcaatgatccatacagatttttgttttacgtagtgaaaaatatgaaaacaggacatatttattaatttcttctatcaatctgtacctaacaacgtccgttcttccttcaagctccttgacgaaataaaatacagttttttttcttcatgttattgttgtttgtgtgattaattgagcacttggcgaccattaattcttcgtttccatggaacagcatacacggactcatatctttacgaattgtgcaggcctgttttcaagttcattaaagcctattaaggcccatttactgatataataattaattcagggtccgtcgaaaatagatatttaattcaggggccgttcttttgttccgtttaacgacatcgtttcgtctttcccctccttctcccgttctccggtcctcatgcctgccggaatcagctggttagtagaactctctctctcgctgggatggacttgctagttgctaaggatttttttcttctttttgatgatgattggttgataattctagctggtttctctgaataatctagttttatatgtacatctttatattcagtttaaaatttttgcggattaatttagagttatctgtttagttgaggggacaagggtttatctttaaattttgttattgatgtttttgtatgcttataaacttgtaatggttttggttctcgataatgtgcttgaacagtattgctctctgtgtttctgtccatggtgaatcgcacatgcttcttcaagtcatgtgatgatgtctctgttgtagccatcctcttgaaacttgaacctttttggtttgttttttgccaaatctatctttactgagttattattccaattatcaggtcggtttggactctcaatggagagtgtggaagcttccaagcaaatatggtggtatctggtgtcaaatagtgtttctttattatcttctgcccatagatcttaaacgtaaaagcatccaaagatgcattaattaacgataacatggggatgaggtccatgtgcctctgcaacacctcttatgcaatcacattctcttgcttccctaagttactgctgccaacattgaaagaaacacaaagtgcagtgattttaataatcaaatattatgttaagacgtaagagcaagctgattgatggctataaatagaaatgtccgcatagtgtttgtttggtgtgatcagagtgaga

SEQ ID NO: 4573 - DNA, 2000 bp, Arabidopsis thaliana
aatatgctaaaaaaaagaagtcccataaagcaaaagaatgcgtgtctcgtgaggttctttatgagattgatcgttgttacttgtgaagaagcttcggcaaaagcgtgaagagagccatcttcttcgatctctcattagtccttttgttctctattcactccacccaatcaccgattgtttcttactttattagtttagttttactagtttattacgttaacataaatttattagtttagatttactactttataacgttagtttagcgttaagccacaatggaccttggcacggcactgacattgacatatatgagttggttagatagagctgcggcgatcgcattttgttaatcttcacaaagttttgacttgttattatgctgcatttatattttggttacaattttgtgttctttctaaaaattatatgtgaaaacatgaatgtgggtgaatacaatgcacctaaagaaagtggtatgacatttgtgacacgaccgttacacataataaagggttttctttattgttcaactaagttagttaagaaacaataatagtttttgtgatacaattaatctctatttatagagtttaccattacgtatcgtatactactcactcactctaaatccattagtaacgtatcttatcttagttaaataagtaaatttgtttttgacaatcttaagtatgtaaaaaaaggattaatgtaaaaaaaagtatagcaaagagagataatagcttttgtttaggataatgtataattaaataaacatttttgtttgtcaaatataggtaaatatttggggtcaaatatgcaccaaaggattcgaaatttaggatatttatggatagtgtgaatttggaaatatgttttccaacattgtttgattgcatttgaatgttgtctaacgttctactgctaaatccatgacggatctcatattggatactcgatttttttttttctattatcaaattaatcgtatatgagtataatatttaattaaatatttaattggcctataaacctcaggcgtatcattttttttttgttttgaactttgaagtacaagttaaaagagataagctctctaaaataagtaaatacaaaactctgacgaatctttcacatcgccacgtcatgaagatatcattgcgttctcaacttcgaggcttaataataatatcttatttttttccggatagtatttctctgataatcaaatgtgtataaatgaaatctctttcttctttagaattactgtttctctccgctacaaataccagatttttctctctctcgtcgaaagcaaaacagtctcctttctctatcttctgctcatatcagccattgacacagttgctttgggtttccctcaaacggcgccgattgtctggttcgtctccctaaatctctcttcatagctcctatatacgtgcctttgcgtatgtataggtgttttctcatctctgtgactatctatattcgccggcaaaatttctcggtctgttgattttgatttttttctctgtaccatttagatttgaattggtgttgaattttccttgaggtgatgagtttgttgtctctctgtttctgctaaagtctttctctaatcattctctttcttgggtttcgataaatttctcgaatttgtaagctaaacttaatccgacgatgatcaatggaaaatttggatgattggttatgagttttcggaagattctaactttcaatcccaagtttttatgggtcgtttttaatttcatctgtttccaaaatttcaaattttagggttcttcgataatatagggttttagattttctggattttttaaaatcttttgcattttttctgattaacctaattctcatctggataaaaataggctatctttgtgtgtttcacttgtaaatcttataatatattgcattcaatctggatctaatgttggggaaataaacacatttttttttcaggattttgaccactg

SEQ ID NO: 4574 - DNA, 2000 bp, Arabidopsis thaliana
ttaaaataatcttgctgtgaatgtctactcgttgaactttgaaccaaaaaaaaaaaaaaaatctaagaagtataataattagagactaatagagtcaataactcattctttaaaatatatagaactagctggaaacaatagatttgaatggtactacttagaatccagcagggttctttaaagtcatcatgaagcaatgcaaagtctaccactcttggcgtaattgttttttggcacaaaagttaatgcaaaagtcttgattatcgcaatttttcttatgatgcctttggtttctaacatcagaggataaaaaaagaatttcacgaacaaaaattgtgaattttgatatgcatagaggcgagctatagactccctaacgtgctattgcgtcgagccgtggtgcttacctagttacacagtataacaagcctgctttagttttatttcataaaccaatataatgtaaatcacttactatggcttttcgtatttagtaaacaattttacatttataattttcagttgacctaaattaaaaaatatgtactacaattaatcaatagttactacgtattactaaagaatcaatatttgttatgtggtaatcaatgatgtcacgtcaattcttgacattattttgtacgatttagaaagctaccgtctactaaaatatgtgcataatttaacgttcattattttagaaaacagtttgctttgtctatttttctgagtgtcaactctcatttacaactcatcagtaaatatatagataacaagtcacaagtgtctcccataatgattaagttaggttgacttaaaacatgattaaggtcagacacacacacacatacatatatagaaagctttcagtttttagaactagttagtgacaataaaaagcctattggtgaaacatcagcacttgtaacaacttttaagtatatttattcaaatacatcataatagatttttgatcaaaagagatcatcatgttcctaaaagtaatacttgacttgaattttcatggcttggcacaaactgagagataaatgtcttttttcaatcattaaatatcttaaaatatatatatatatatatatatatatatatcttaaacatgaatgtttttgttttggtataaacgtgaattattcatgaactgttaataggtttcaatgtcaattggatcgaattattgtatatatctcttgcttgaaactatatgtcgtgtgtcttcatttttttgttttcctaattgaatactttatacatgcatgtagtattattatacaaaaccaagataattttttttaatgcttctgttgatgatctgagtaattttggacatatctaagagttaagggtgtaaagtgcaattttcagcaaataaaacgtggttcccgctaacccatgttatcatttttggtttcaaccttcagcaaacttaattaatatttggttatgaactttattaaaattttgcaagattatcataagattgtcgtataaagagtgctgaatcttgacttaatttcataaaactgctgatctaaaatcgacatctatgtagtaagttctgatcggtttgcttgaacatatacggttgagctaggacaattattctttgatttattactttaaatactagtatcaattttattcacaaatttatttttgtaatttttttatacaagcctttaatttaccttttttttattcacacattacatggcaatcacttaatcaccaaaaaccgtataggattaggatcgtaatttgcaagttattaagaagatttggcagattacatctctaattcaataatgttgttacgtcacataacttcttaaataattgataaactctcttaaatacgaacttaattggtctagccggaatctaaagtcaaccctaaactcctccttcttccttttaagagacacacaagagacaacctttcttctccgtatctctctttctctctctcagctctctcaaac

SEQ ID NO: 4575 - DNA, 1174 bp, Arabidopsis thaliana
gaaaaaaatggaaaaatctaagtaaaaatttcatgaatcataatcccatttgttgtatgttttatgctgttgtcgtatttgtacttaatttatagtttatagcccaaaaaaaaaattcgtttctttttaaaatttatggattcacattttctcggttagtgcgtaatctacaaattcactctcgtccggttgagtagtattggttaagttcggtacgtgaaggagagtcagggtgggttaatccggttaaggttcatgttttcgatttacaacttctattaaccagagtactcaaaccgaatttcatacagctcaggtttatatggttttgatatccacttagctttgatttttatcaaattataccaagttcgattcaaccaagtttcactatcacaaaattgcaaaaaaaataaatataaaaagtaaacagtcaaattaaaaatctcatgaaaaattaggagttgttagtgaaaatattagtgataatcccttcgtttcaatttatttataatttaagaattttgcatacacataaaaagttaagacactacataaattatgtaaattgtttatcttttttatactataacgtcattttttatttaaaataatatatgcaaccaataacaaaatattctgcataataccaatataatcaaaagaaataaataatcataaatttttgcaaaaaaatattaatgaatagcatttatttttcaacaaaaactttaaaatacaaataaattaaaacagaggaagtacttaattaaatattttggtatttattactactgtttaatttcaatataaaaaaaaatcaactttaactaatttatgcgtaagctcattgtgagagttaaacatagttgggagttacccatctcccgcaatcgtaacccataacgtcttttgtttgcatccatcgctctctcatacaaaattcagatctgaagcacacacaagcttcggattccagatcaaatccggcgattcaagccgctttcccaaattcaccgtcgatctggagccgttacaggatccgccgcagaccacggcgtcctccggtaccggcaacggcaacggtaagatacgctaccgttcgccttcttccactgagctcctggagtctggtaaccattctcctacatccgactctgttgacggaggtaag

SEQ ID NO: 4576 - DNA, 2000 bp, Arabidopsis thaliana
tatatttctcaaatagtttaatgtgggtgctcttagagtatggtcatttatattttctcaaatagttttattttgtcaacgtttggtgtatcaactattttgcaaatagcagatactttcagtgaaattccttatcatcgaggtcatacctcctttggcatacattgtaaagtctctaacataagccaacaacttgcaagctctaatgattcacaagttgataacaccattttgcaagctctaataatgattcattaaacaaattggcaattttcaaataccaacaccaccctttttcttgttaaaattactattgtttattttattttatttaatgttaaattatatttaaaagaaaaataaccttggtacatatgaaatgctaactttttcaagagttattttaaaaaaacagaatttctaatatatctattgtcttgattcaaaccaaatttggatgccatttttgaacttcaatcctccaccaccttgaattgtgctcaaacggtttctaatattcttgtctatgatcatcacaagtatttccgttggtgatgattgctccccatgcctcctcctattctgttcattccatattgagtgtatagagttctgtagtgcataccgaagtatgtagctcttcgttttgtccacaaggttttcagataaaatcttcataacctctgtccaactcaccgagaatctgtccgagaaaattccccttgttaggtcttcccatatctttttgagtataggcagtggaaaaataagtgttccctcgtctctactcgttcattgcaaaaaatgcagctcgaatctacattacaattccacttcctcattctctcccctgttgcgactctgttttttacaaccgtattgttatactttggagtagcgtatgggaaccatatctcattttgtccctccatcggcggctttgctaaccgcagctgtgaccaagaacatttatttttcccttttaacagaactatatcgtgatcgttcagttctccattcagcttctgttttcttatttcttcttcaacacggtttaagataccctttcgatggtttctccttcgtgtcatggacatcacctctttcattgtgcttgaactaggaatccctagatcaatgcatcctctctaagacatcccatgttactccatgtgtcaataccaaaaagacgtagtttcgccgcttttaaccactaccatgactgttgatctctttaaataattaaaaagtggtgttccccatgaagaccgttcacttccatcaatttatggtcttcttggaccaatttcgtttatccaaactattacccctacaacatcgtttataaattgtctttacattttgatctagaatttgatctattttgcacgaatcctcttccaccttttcaggcatgtacgagcaatataacatgagtttgatcaaattttgcatggtctctacgaagttgagtcatgcaatttttacctataatttttgttctcggcatttttatagctctctacttaggatataagtaacatggagttggatgaatccttttctttatattgaaatcgaatcttcaatgctaaaaataaaatccactcaatcagtgagagaattattatggaacaagctataaagacgaaagaatcactcaatcatacaataaagaaggatgtttttttcatttaaactaagaaagagaacttttccacgtgaattaaaatagacatctcaataataaagacgattttttttcttctctttttcctctcactttgtattgtattgtatttctatatatttcttcctcttacaaatacccttttaaattggaaagaaaaaacaggaatcgctatcatcagtaatagtcatcattaatcaatttatatgtaatatgtggctgacaatttccatgtacgtgtaatatgtaatatataaacacaacttatggccagtataatattaatgcttaaaccgactcgagaactaaa

SEQ ID NO: 4577 - DNA, 2000 bp, Arabidopsis thaliana
aaaagttcacatattcatgatagattatgactttagtttattactttctacagaagcagaataagaatgacctggtgaagggatccaaaaacagttttcaagattttgtcctccactatcccttaaaacaaaagataaaaatttacttgcgttttagttagtggaaatcgaaaaaaaggtagactaaaataatcacttgttcaccaatagagaaaaaaacgaaaatcttaaaaagttgtacaggtggcaaagacgaatgaatacttttcttagattgggacctgttttgggtttggattttgagctagacatttaaaattcagcagctttacctaatggcgaattcaatcttaatcgtgaagaatcaaatttgatcccaaaagtcgccggcggagaaatcgagctaacaggagacaatcgaaaaccatcaatttattctctggtttattggatgttaagggaagtaggttcgattgtagaagatggacgaacaacaaagcagaagacgattgtaactttgtttagtcgaacacacatgtacagacaagtagagttggtttagtcgggaaaatcgcaccctaaaaaaaacaaaaacaatacataagttttaaaatatttctaaattatgggccacaaagagctggcccagtagccccgcttctcataacagattttttttgtctctggcggataacaaaaatatccttggaaacgacagcccaaacaaaatcatctttaacatatatttagatgttacttgaaatttgatcatatattttgaaaaaatccagataaattattaaaagttaatggtattaaaaaaaaagtttcattgtttttagttgaagaaaatagtgtcattttgattctacatttgatataattttactaaaaattgttttttttctgtgttaaaaaaaaacagcatttttgaggattgaatatgaaggtggatttctttaaagttgtgtcacaactgataaaaataaaaataagaatcaagttggggagtggcaatgaaaggaataattctaatggcggcttttattggcaaccttcggaaaaataataaaaacattcgtatactttgccgtcaaacttaggaacgtcgtcgttttcgtcgtaatataattggcgtaacgcaactctaaaacgaatcaggatgttccacgtacactacactaggcttttaatgtggagcccgtgagagagccacccctacttggcattgacgcaaagatttatatttgggtcaacatcagcaactgtacttaagtacttatatatattaattataagattatcttcttctttttttttggtttaatataagattaccttcttaatatcacgacaactaatctaatcttctccttattttttgggttttttgatagaagaagaaaggtcccgtaaataaatgaaacagtttcggaattcttctatttttgtcgaccacttgtgttatccgcagctagttgcaaaattcttttgtttgattgtataatcaaattgattaatgaatcaaataaattggcaggaaaaaaaaaaaaaaaaaaaaggaagcacaaatgtcagtgaggtgagcccaagtcttcgccacctctctctgctttcttagtttgctactttgctttgccttttcccaaagaagaaccataaaagtatgatttcttattgaagccaagactagaatctatcgtctagggttctttctgggttccaaggaaaaatgggttcatcgaagaggcaattcaaggccatgctccgcaagaattggctcctcaaaactcgtcatcccttcgttacttcagctgaggtttctctctttttctttgctcctcaaaactatgtcgttttcatgcttattcactgctcgtcttaatgggtcttcttctccttgatgctgaatgcaatttttgtttttaaaatttcgaattgttgatcaaattttgcttctttctcttattcattggcagattttgcttccgactattgta

SEQ ID NO: 4578 - DNA, 2000 bp, Arabidopsis thaliana
tttcgtagtttttctattgaatggactcaaattaatatcgtgtgaaacttttgaaaatactgaaaaggcccttttagtgcaataattcaaattgaatatgaccttgaattgttttaaaatcatttttcttctcttgattgaacctaattgaactacaaaactatggtcaaaatatatgaatggtattgagtctattgagttttgtcctactcatataatttggcagttcatgaaaagaaatggatcttaagtggaatatgcgtcacctgtcataattataggttgaatgatgaatgtttagttttatttgtcaactatttttttttcgaggataatgtttgttttttgtcttttccagtacgataatgcttaaactaacattctcaactatcaaaacattccaacgtataccgaaatgaaagttgacgtgataaatccgatcaagaacacagcttcttaacgtggctactgtcgtcgaccgacgtttattaaattaagttttcttatatacataaaattcgttcaatttaaattaatgtggtgaattcgcaagtttaaaatttcacagaaaaaatgttttttataactataaacgcttaatctcatgcacgttctcttttcaggagatatgtaactaactaatgtattccatgatgaatgtttgggaaaattaattatagtggatacttgttataaaacttgtatgagtcaatggccttaatatttgataagtatacttaaaactttatttggacattaaaccgccactaattttccatagcacatatagtcaacttaacaaattataggttagtgttgtttggtaataaattagtaatttagtaaaccaaacaatttataaccattttattcaatcagtgtaggcaaagaatcttgaaatagtgttttctattcttatgtatatatttgacaacgtggtgttttgtcaaccaataaaattttctaacaccataacataaatctaaacttgacatgttaaatttccttagcttagtgaaacttgattaaattatgcccttccaatttttctcaccatttttaccctccaaaatttcttaaacattccacacatcaactatttcacagctttacaatgacgagccatcactttcgtacaacaacaaaagtaataatagattttctggtacatgtatcgaaaagttgtgcggcctgcgtcagaaaaatctaagaaaaaaacaaagagtaaacaaaaatatccaaacagtgaatctaataataaattctgtttactttctgcaaaaaataggataaaatcgaatttaattctttttatcgaaagtcggaaatatatcctatgtcgcaatcaattaatgtacatatgcaagaaatttaaattaaaaaaaaaagaacgcaaaaaaagaaaaagaaaaagagagagagaaagaaagaaatcgagtttaactgctcgtgtctctctgtgccactcgtcttcagttttgtcagcgtcttcataacttataaagtcctatcgatctctcttcttctttctttggccactctctgtgtctttctttgttaataatatctcaaagaataagaaaaaaaaaaagaaaagaacaaaaaaaagcacaagtttcttgaaaccgtgttgttttcgtgtaatatacacagttgttacagattctctccttttgggtttctttttgtaatcatcatttgattgactgattctctgttctttttttcccaaaaagagagtccttttattacaaaaaaaatattaaggttctgttttgtttggtttagcttttttatccaattccatcagaaccagagttgtttgttgctgctctgtaatatactcgagtcaatctttatacttaaggaaaaaaaaagtttcaatctttggtttcatctcaggcgaaaattgctacaaatggtaatcgatttctagggctctgactggttttgattaaaggaatcaattcaggggaatttcgagttcttttgttacaaaa

SEQ ID NO: 4579 - DNA, 2000 bp, Arabidopsis thaliana
tgttatataagttttgatactatattcgaataaagtgtaatataccttttcaatttgcattctttaactaatatatttgttaatcttatatttatcaaaaccgactatcgtttcttatctctatagcatttttgcaagactgttttggtggatttgggtaaaagtgcattcgagtcatatggtacattcccctattaaataaatatggtgcactcctatgttattagataaaatgtttagattataattcagagtcatatcataagtaaaattaatattaataaaataaatggctttttcgcaagacggatttggagggacgggtttttgaatcaacattaataaaaaagtaaaataaaattaatccaccgtttcaatacgggttacatcttgaatttttttttaagaccactaatattaaacatatcaaatcatcttaatttagaaaatgttatataaaaccaaaaatgttatgtggtatgtataatgttactatatataaaattaaactataaaatataaatgtattagagaatgatacaatttgcaaaacttttatatataataaataattcttaaattttaaaaattactacttaaaaaaaatcacgggacgggtaaagaaattaccgaacgagttttattttggaattgggttatatggtggatgtatttgaatcaatatttataaaattttaaaatattattaatatgttgttttaataagggttaaaacttcagttttttaacaattgtctcatggattcgtggtatactgttacttaataacaattatacactgtaaaatataactattttataaaaataaaatttgcaagttttaatatctattacctttaaaaaataaatcgtctcgcgatataccgcgggttaaaatctagtattgttgtattactctacgatgtggtgttttggttatatataaaattctatagattcgaatggaaaagaaaaactacatatataaggatttcaatttaaaaacttatcgtcaaccattgacataaaaatctctaaaccttcaattttcaacccacagattgatttcctactaaatatctcaaaaggtgctgcaaattaaataattttactggtaacaacttgttgtcctactaatcttatggttaagtctaaaccacatgtaaccctttttatataagggagagtcttgtaacagaacaagttaagttgagagtgaaagacattgattgatggattaatatattatagttttttttgaatgatgaaacataagttttcttcgttttacacatgaaaaagcttagttaattttgcagttggttaaaaggaaaaagtcgttgattggctttctcttaacacttgtagggttttttttacctcaaagtctctaaattaaataattaacacatagcagcctctaaaaagttagtgtattttgatataatagattaaccatcaccatgtcaattcaaatacaagtgtatgtcttcaaatttcattaatttattttcttctcatctataaaaacagcatcagattttctttttcaaaatggttaagattttattcacccaaaacaaaaactttttttaaaagtttttaacaaaaaaaaatcaaatcaatacccaaaaaaatattagaaaattgattgctagtaatagaatcctatattataatttgactagagttttaaccaaaattcaatactgacacatatcatttaataatactaccaaaacaaaacacatgtgaatccatccataatatataccataatttgattaatacaacaatgattttgtctacatttagccattttattaaatgctagttgctatattagctattttttccttaatatcataaaaacaatttttttggtcgcacgtattaacattttttttcctatataattcatgaatgattaaacccaagatcctcactcgttggtccttagtcttcgacctcctttaatctctccatctctttctcttaag

SEQ ID NO: 4580 - DNA, 2000 bp, Arabidopsis thaliana
ttatactcataattagtgtatggaagaacatttataagtcaagaatattaagctatcaaccaacgagataaatgtattgacaatgttcatagttgcagcatgagctatatatatttttctcttagttgatcatcatacattatcaaagctgcaagatgtgtaactgcattggctccacttcctttgttgtcttctttcttgaatagtggtgttcaatagtgtaagatatctttctatagtttcagcacttagcaggctgcttaaaattggcctggcccattcgattctttgatttcggtatgaactgttagaattctgattgaattcagataccaaaccttgccaaaaagaaaaaaaaaacggtttaaatgaatattaacttactttgaccaaaaattgatggcagggtaaaaagactcaagataatccaaggtcaaacctattttaatttcagaactttataataatcgttttaaactgaaattggtttaatgtaaaaatttaaccaacctgaaccgagaactacaatcaaagtaaacaggagattatattaaatcgaaccactcttacaactcataggggtgggcgtacggttttatgatttggttttggtttggttttttcggttttataaaaactataatcatagaaaaacagaaaaacagtatgtaattcagtttggttccggttcggttttataaatattaaaaccatatgtatctcagttcggtttggattcgatttgtttttggtttggtcccggttttttagttattccatacttttacaaaaaaaaataagttcgatgatttataaataaaaataaacataaaagaaaataatatatcaatcaataagttagatataatagatatctttttaaaattaaattcttggtttctaaattactaaaaaaattaataattctaagcctactaaatttttttttttaaaatgaaactattattaatcaaactaatcacactataaaatggacaaaaatatttatcaataattatttttaatttctctaaaaaacctaaaaataatctggttttacggtttttaaccaaaccaaaccgaaataataataaaaaaatacaaccaaatagtttttttttttaaaactataaccaaaccaaactatttttttcgatcgggtacggtccgggttttcggttttcggtttttttgcccacccttacttacaagtcaaatgatgacatttttttaccggttaacataaaaaacacacacacacacaagttatagatgtttgtttactcttattgtgaaaattaggcccatttactagtgccccacataaaactaagataaacaaatttagggattacaatttttcattttctctataagcttggctttctacctctcaatctctatttttctacttttaagagaaaaaaactataaaaaaagaataagaatctttgtgcgataaataaaattaagaaaaaaactctaaaaccttaaagaaaacccttaaaaaaaatcatggaggtacgtataagttttgtaagaaaaaaacagatttatggagatacatatacataatattatttctgaaaaatacatatacataattttattttacccattaacaagtttgtaaattctcctcttccctctatacacctcttcaattacttctcttaaatcttttttcctctgtaatcaactcaaaaaattgtttacaaaaatttgctaaaactctcttcaaaaatatttaacacaattaacaaaaacaaattccaaaactttgtaataagacaataagtaatcaatctccaaaaaaaaaaaaaacaaaaaaaaaaaaaccttgttggtttgtttgggtcttgccgtttcgtataaaagtgcgaagtaccctctctctacccaattcctcttgttttgtttctctttcataatctccaatcttcttcggattcgacgaatccgtcatcgccgacggaatcgtggccgtgtaatattaacag

SEQ ID NO: 4581 - DNA, 2000 bp, Arabidopsis thaliana
aaaagtggggctttcggaacagaacaaataaaatttgacgcactttattgtgttgcaagctacttcttgaagtatatattttgattctcgaaacgtcttcagttctgtacaaatttaaatattctattgaaaaagaaatcttggtcgtcgtcgtcgaatcggatacgttaacgttacgacatacgagtcaccattagggccgtagacgaaatactaggagacgcatgaaggtcacgtgtatcaccgttgcagcacataagttttcacctctcagtattgaacatgcgccgtatttcaatttcaagcttataagaatattattttctgttttgtctcgtcacgtagaagaacactcaacacaacgggtcatataaaaacaatcaattgaccaattgaaacacttaccattagctttactaaaacaaaaagtgctacagctcaattatttcgacgtactttttttttttttttttttggtcttttgtggcctatttcgacgttctttaaaaccacgatcatagtggtttgggatatagtaattaatttcatgtgtttaaccaaaaggtaggaaaagtaattaattattagttgttgagaaatcaagttgcaaaggagattaccggcgactccgttggtttatgaaacaaacaatgagacggtttagaatgacggtggccccaatattttaggtctgctcatattattttgaatgatttaattttttttatttaaataaggtacccttatatacataaatgatttaatttagtaaaagcttttgtttatattgcttttatacaagtttttgggtatgactattttaacctcaatcctcaaaactataaaatctattattgcacgcttggattttatatatatatattcaatctataagaactaaaaaataaaagtgatcatagtcaaataatttttgcataaatacttaatattgctacccaaaaaaaagaaaattgcataaatttatgtataattacattatgaaaaattattgatatgttgatatacagttttctaggaaatatcaatatgaaaagaaaaaaagaaaaaaaaacattgtaagctatttcccttgaattacactatatgtatgtgtgacagtatatatgtgtgagcttaatcatataattaccgtaacatcactattgatcttgaaagttacgacgacaaaaacaagattccatcatagatctacgtgtatcttttgtgtgattagtatataaccaaagcgattaagtgaatttaaaatttgtagatatttcttacttaactgattatactataagaagcaaaccccaaaaccatctgcatctcaacgacgataatcgtccgaatatgtttttctaatagagtttgctgaccaaatgcaaatggcatcacgtctcttgccgtttgacgctagcaattacacttcttcattgaaactttaaaagtgaacccaaagaattaactcaataataactgatgagtatacaaattattgtttccggctaaaaacctgaaattaactcaaatttggaatggggatattataactttgttcccacgtataacaaattagttcataattaagaggagaatcacaaaaataactgatgtattgatgttcaattttggaaaattaagatatttccaatggtaataatctgttacagccttactgggagtagtatgatactaaaacagtaaatgcattttagaccgacataaacaataattaagaagaagaatgtttgggtcaaatctcaaagttagatattatttttttgctttttgcacaagaaaacagaaaccaaaaaccactagtcaaaaaaccacccatgtattcctcctagtctctaatccaacaactatataaaaacctctcccattctcattttgttactcatcccaaaaataaaaagagtatatctctcacacacatacacaaacttgacagttttttaatttctctgttagtgaactcaaaccttcccatttcc

SEQ ID NO: 4582 - DNA, 2000 bp, Arabidopsis thaliana
cttttcatcgtcctttcgtcttctctcttttggtttatgactcattgaaagggtttgaccagatcataacttctttctctatgggccaaataagtgggcctcacgttatatgaagacagagattctctaaggaaaccaggaatactaggaattgttgaaaagcaaagctataaggcgaggaagttagctaagggcttttcacaggacaatgggttggagcagatggattttatcaagagagatgcaagtctatctcaagcaaagaaccataaattttcaaaagacaagtacctggtgtagaatcattgaagaaacagctccaagtaatgccggtgtagaatcattgatctaaagtgaagtgaagtttatggttttctcttcatgagctaaaatgaagttgcagggagaagctcgggatcaatgggtgcctcagacaagcaaagaaaacggtttagttttctggtttaagctcaagtgggaaattgagaaactgacaactacgtgtgttttgtagttacaagttacctgagcggttttttgcagtcgtatagacatcaagacagggttcgaaagattgttcttgttgagctgcattgctgcaaggtttaagaaattcaaaacagtgaggagatgttgaagataagtcacagatgtcttcaatgtttaaggtacaaagaaagtagacaaggcaaacaaagtcatacatagttctatttcatgtacttgaacaggttctaagatcaaacatcagagtgtattagagaattacctgggcctgtgaagaagttgctgatggagttagaaacaccaaatatttatttattaaaacactaagaaccatacatatatagatttctctatttccaaaaatagaattaaccatagtcaagatctttctcaatgtaaaagaaaaatactaatatttttgtttagagttcagactacgtacgtaatatttttcatatcgtatatgaatttttattcgagtttcttttttacctatttggatcgacaaagaattttggatcgagtttattggccgacaaaagacaattaagattatagttatttgttagtagtatttgattatgaaataccaacacatcttgaatgttttctttatgtcaaaataaataaataaatgcatgcattcttttttttttcccttgcccttaactatgtttaattttgctgtgatcaaatttataggattcgaaatcttgacatgaatgaatggtaggaaaaaaaaaaaagcactgtttaagagttaaaagctgacggtgtcaagtcgccgcagcgaatatttttttgtaaaagaatggtttacacttaaaacactcgaatctcaaatttatatattacctttccttttctctaatttctctacttggtactttttttattttaggaagacgtaatatttgttaccagaggcacacgcatgggtaaaagcggaaacaccagaacgcggatacacgtgtcattgatctaacggtgagttagccaatatcctttgacctctagtctcatcaccaatatgcctggaaaatgattcacaaccgtccacgtggcgatctatatatccacatttacttttataccctctttgcccgttttccttcgggcaacttcagtttttgtttccttgtatttattgacttttgaataaaagaattatttcttctttacaattttagaaaattggaaagctttatttattgtctgacccttttactattcttcgggcagctgttcttaaagacatcttccctcttcctcagacacagcttcttctactggagaagaggaggagaacacaaatccaattcacactggaaacgtaagaagaagcgatcaaagcttaaacttctctttgactcatcattgttgttctctctgttttatttttcttctcaatttcttgtttgaacttgtgaaaatcattgaattgcaattgtgtagtgttgggtcggatcctgagtgatatttcgagaccgatg

SEQ ID NO: 4583 - DNA, 2000 bp, Arabidopsis thaliana
cgagaagttttcctagagattggcctggtaatcgcatagaagtttttcaaacactaagagcttgaataggtttgacttgtgacagatgctatatagactaagtagcttgtggactacatcgtttttatgtttatcattcacgacataaattttagatatgtactatatatgcaagaaaaaaaaaatcttaagaaaaaaaaactaaaataaataaatatatatgaaatgcatcgtattgttgttcataccatataattttcaaatagattaagtaaagaagagaatcatgtaatcccaaacctaactttttcttaaagcccaaactgaaaaaaggacttataagttcgcaaagataagacctagtagaaagttatggaagcaattgataatgagatataacgataattctttgatgaatgcgtccggtccaatatagattttgaaactgaatagtcttcaaccgattttcagaaatatcattttcaccttaagtcactatgaaacaataatggtgccggtctcatctcaactaaattaatggttggaaacgattacctaaaatgtagacaattatctatttggtacgtagtcgtctcctttaagcttcttctttttcgtccaaacatgctttaattttgggaatccgtttagtgatttaattttagaaatcctatcaaattaactagatatgttttgatttgtgatgtatgagtttttgagctttcttggtgaagaagatggtaatgatgtatgatcgtttgtgtcattatctttttttgtttgttttataaataactaaataagtattagtttcgtcggctaaattagtcatacccaagagatcaagcttgtaaggtcaactgcttgttgattagtgattcatagaaattcacaacagcctccactggctagtattcaacaaatttaaaaaatcataaaacaaattatgaggtactaaacaaaaaaagcattataacataaatccaaaatttcccaaatgttggtagaaactagaaagtaaacttcactgagaagctatgaacttttgcctccatccacacgttgttcttttatactcgatatatgcttcatttacaaacaaaataagcttattacatgagttacatggaattcaatagaggaagtaaggactcttctgtccagagttcaattttaattataaataataaagtcatggtatttttagtaggtttcggtccaagattaacaagatggcttgctttttcaatgagtcatttcaccatagtattagtcagacttgtatgtgatgtgtcggatggttgtgtcgctatggatggtccttgcaaagcaatttgaattttgttctctccaatacgatgtcgacttagatcacttagtaagaaaagaaaaatctaatgatttgacaacatgcggtttgtttgttttttaatggacgagtaaacatgtccattgctcgtattcagcaattgttaaaatctagtctatgttcgaaagtttgttaccgacaatgagtatgcaatagaatttgaggttggcttttgtattatgaatcttcacactcatcttaagcttatatgatcggttctatatgtaataaacttatcttttgtttcggttccagtttcaattctttcaattcggttattttgtccggacctagtccgaatcctttaatctcggtttaatttataagcccaggtctaacgtgatccacgtcaccaacgatactgaacataactccacattagcaatccgatgccttctccaacataaaagaaaaacacttacttatcatcatctatcagccgtagattaagatatttagtatcctcaatctaacaaacacaaaatcaccacgtcatcaatccttgtcaaattctctcatccaatcaaatccattacttcctccttaatatctttcaccgcttcatcatcttcttcatcatcatcaatcacaaaaatccaaatcccaaaactttcccgagaaaactaaaaaa

SEQ ID NO: 4584 - DNA, 2000 bp, Arabidopsis thaliana
tcaagactctatggatagaaccaactattgaaataatggggacatatttagacggcttggctagaggaaaagtgattgatgaggcataacgagttgtcaagactttgattttcaagcctaactaggagattgctgtgagtcttttatcaaagtacaaaagccattcaacacccattgagtttgctaaacgttttgtgaggtaccttgaagagaagaaagtcaccttctacattgctggaacgacttataaggtactagacgaagatggggtggagtggaaatctaatgtcaagattaagaaacagaagaaaggaaaatccacaatccactcccattagagcagttcaaagtactatatattgctgcacagctaaatcattcgtcaaaggcatttcttaaccatgctatttgacctgaggttacgagagtaaggatataattgtattgattgttttgaaacagtgaaataaacatgaaaaagtgcagtgaaataaacatgaaaaagtgcatactcccacatatgtgccccatatgctctaacaaacttgataagtgtcatacgtagtgagatacccttatattttttttagctttttatatactattgcttacaaaccttattaatatagttaaataattagggtgggcatcggtttggattaagtaatgattttggataatgattaaaaaataattttgatttttttttcaacttcagaaaactcaatcttaacttttaaaaatgtttatgtcttttcacaactataatattttatatctataagtaaaaaacttgttagaaaacttatcttactttgataaaagattcattttgattaattatctttgttatcctgtaaattctcggttttgacattaatcactcaattccggtattttaataaattacaaaatgagttttgtgcagtgttgaagatatattctcaaatacagtaattgctttcaacccttgatttcgaaatgcctaagcttgaaatcctaagctgtccatacaccaagacctacatctccagatctctataacagtcataaaaaaacttctgcctatactttatttattagttttcatatttccatccgtttatttgcaaggcccattactgcactaggccctacattttgttagaagaggcaaagcttataagcgacattctcaatttccaactattacccttccgaactcttcacctaacacacattttctaggggtaaacgtgtcatatcgtatgcagaaacgtgatcccagcatatccggttcttctttatcctttgttggaggcaatatctacgtagacagttacctcgtacaccttcagtaaaatggacggttgagattcctatttcagtaaatagctaatatctaccgtcagattctcactgaacagattaagcatacaacgtcagctgaagtgtttagatgttaccatacaccatctgtagagaatctctgaccttatcgcataattttttaatgttttgcagaatttttgtaggttgcttatttgctttttctttcatattttttcgttaattgttgttgttatcttcaacgatagcgttgtgctctggagaagtgtttgatcgcagaaaagcttcgttctttgtagtctacaggtttgatcactgagttcttaacttcttttttggtttgattgcgatcctgtactttcgtttagattacttaaaggttgggtctttaacatgatcgactgatagatttgtgggaattttgataatctgagttccagagtttgggaattgatgatttgatttgagtgttaaatttgttttgatggttgtctgattggtgtcacctatttgttatgtgtgtgtaggcgtggaaggaatggcaaaaagctcgttcaagcaagagcatgacttaggtttggatttgagctttgttcttgctttactgtttggtcctcgaaatcaaaaccttgtgctttgatctaatgatcctgtttcctaaatcttcagag

SEQ ID NO: 4585 - DNA, 765 bp, Arabidopsis thaliana
gtgctatgtttcttgtttttgttttgtttcaatcatatttggattagaagttataatcatttaataatgttttaagctcattcaacatagttatagtttctaactcgttcttgatgactagttcgttggaggagactaattgcttcattattggtttatagaatgattagaacccttaagctctcgaaaaatatataaatagatagatatgtagtcgttttcagttttaacacggtgctacagagtttcttgaccgattcaacacgaattgttgaacatgttaccgagctcttgttttctctctttaacatctctatttgtgtcgctgtcaggaagtaattgtttagacttttcatcgatgtgttatacttcggtttcttgttcttgaatttgtctaagtcttggtttctttcgtttgatttttgattgaataggtaatattgtgtggttatgtagacgtggactcagtctaatggatgataagaatctccaaaactgaagctacgaagaggtacaatacaagccaaggactctttcctccatagagaagtagcgggtcgatcttatggtaatatataagcactaagcagatgggcgtttgatcatataaaccctcactaccattaccaaaaagcaatagccaagagctttttttttcattttctttttgaaagccatggatcggttttcgttcttgaatgttataatggaggttgcgggtattctaaatgaatcccgcaaactctcctcaagaacaaaaagttg

SEQ ID NO: 4586 - DNA, 2000 bp, Arabidopsis thaliana
gatgctgttccaaaaccagttgttgttgatcctccattatacgacgaagcttctccgtcagcttctcagcgccgtccggtggtgatcgccgccgatgcagctcctccggcagaaaatcatctcattcaaaggattcaaagagctcttgtggaattgcgcgagttgagaaatcagtttaatgccattcttagggaactagaattcgaaggtttgtgtgtgtttcatcttcctattctacgttgtgttttctagaaaaagagataaacaattttgatgataatgcagtgggagaagaagaagagcaagcggaatcatcagtggaagatccagaggactctgattcttagtttgtttattagactttttttttttgtttcttcactagtaacctatttctatcatgtttctatctctctgcccctcatgatttcctgcggtaattatctttatcactctaaatcatcaaagccaacccttaacagatcaataagtctactaaaagagaaattacaagtttttttgaaggaagaatcaaacacattccacataacatataatatgcagttgtctatcgtaaatgttttaccttgacaatggttttcgcaagtaacgcataatggtcgagaaacattacatttgcgacgaatttgaaccttattcccatatatctcgagaaggtgacattgcttcatttatgggtattcaccaaataagcattcaatatgaatggtagtaataaagattaccactcgtacttctatgaacttggattcaagttagagccattgtgagtccacttctgaatctttccacttaccaacccatttagatgttgcagaattaccatttctattggttttcctatctgcttctttatctttgagaagccagcttaagttttagcgcatttagctcttattgcaagattgcattgtgtcataaaaggtcgttctaagtaaaatctggcacatgtttttccagttagtggattcatttgtgaaacagtttggaaaatgttgcggttaagaactgtattgccaaaaataaattaaatgtttttcatcattactcattggtgactgaaatgaattgaggtccctatactcttattgcttctcagcatcgagttgtttgtgcatcaccattgtcatgactcatgatttttagaatcatttatgcaattcatcatcttaatcattatcattataggatgattgtatcatatataacagtcgaaagggaagggccaaaaaaagtgaaataaagttttgttctttgtaatggaagaaaaagttgggaggagaatcatggtttcactatggttctttggaattttgattttggtagttagtgcccaggttccgggaaccaaattctgatcatactacaaaaaaatatcttgcggattattgtagctcttgtcttgcataacatgaagcttggaattaactaaagaaagtttcttagagattcttcttcttgtttgttctctaaagaatctaacactctttgtaatgtttatctaaacttggaactaattagatgtgaaacactacaattcattaaacatgagatcatgcgtataggaatttggttcctgctgcaccgtggcaagtcgtacaccatatacctttttccctattttattcatattttactttatattcactttacaataaatatctttagatatttctacaataagatccttatctctctccatggtttaattaaaaataaatccaagaaaagtgcataaaaagatatgtactttttattcctctacccaatcacttcacagcttcactcacgcgcgtgttctttgatatcagatagatacgtctacgtgagatacacgctcttgttaatcaagtggtgatgaaacagaacttactcgcctcggtgtccgattctactcagaagatatttactataaatatctgatttctctcgactttgacgaaaatcaaaaagagagaaaaacacaattaaaaattatt

SEQ ID NO: 4587 - DNA, 1588 bp, Arabidopsis thaliana
aaacttgtacactttctgatgtgagcatttgcatttaatcttgcacacactttgaattcaaagagacagtttcatctcatggtagtcgcaaaacaatttatgctaaaaagtggagacttattagtttcagattatctttcagaaatgtttgctattttataacaagaacgagtgtagacctctttccatgtgtgcttaagttgtgaccttggtgaatctctgtagatgcattcagttccaactttgttggtccattaattgatttttctttatattatcttatttgcagatatgcagacactgtggtgggggagactgggtggtgcaaagcggagtgaaatgcaattcccttgcgtgctcagtcttttacgagagacggaaagttcagaaagagcttcgtggcctctcctccattgctactgagagtgagctttaccctaaatgcatggctgagtggttctaaccttgacgaaaactcaaaaaaaaaaaaaaaaaaccagtaatctaactctatcccatacgtatttccactcaaactaatctaaaccatcctatcctgttaagtaacgatgtgaatttttgtatttgcaggattttgagcgaactagtaggtttatatggttgtgatcaaagagcatttttttcaaggacgtgtgaatatgtgtatagatagtagtagcacccacgagtacagtactgtcactcatcattctgttcaactcctttgtgttgtgttgtgtataagcaatcttggaaaaaataattataattttgtatagcataccaagttcacgagaaagatagatagatagataaagaaacaaaaacaacataacaaaaaaaattaacagaagaaacaaaaacgcctacgagtcttttgggtggtggtgagatggtgcaatgcttcaatctctctctttttaagactttcgagcacaaccaactgtttcacacaaaatgggtgataatcccttcaatgtaggcaaaacttatagaatgcttaagaaaactgaataaggaaaaaacctcacctcttcaatagcacgctcccgcaaaatcgtaaagtgcatagccctgtgtttggatataatcttcgtatccatatatgataaagcaactacatggaaactggcagagttatatcaaacatataaatggtcatggatatgagtgtacaaaaagtaaaacagatttggtcatacacaatttgaatttcttcccgtaataaacatattcttaggctctatatatatatattgtatcaatgttattgagatcaataacacataataaagagttttcccccaaacccttctctagttagtagtttctataattttggcaaatagtattcaagtgctcttgcattctcaagtgattaattcaattcctaggtttcggtttcggtttcggtttggttcggttcgtctcggttattttaggaaaagaaaacaaaattagagagcaaacacgattggtcaaagtcaactcttctctaccttcctcacttcccagcttcactgatcatcgccaatcacaaaaccaactacacacattcatcatcatttcgattatattttacccgacc

SEQ ID NO: 4588 - DNA, 2000 bp, Arabidopsis thaliana
aattattctacaataagggttttgattcgtcggcccaaatttaccatatgggccttaagaagcctggttaaaatatatggccactggataatacaactatctttctttctttttttctttagtaatatatggcatcagtattagtgtcaatgatttatagatgtgaataaagtgaaatttttggaaagctaattgataactttgatgaccaatatataacaaataagtttgtctattgcagtactttaattcattgcttgcgtaagaagtgagtgggatcacaatttaaagaacgtcacttgattcaactactactaaaataaaacaatcagaaaaaaaaaatattaacagaggaaaataaaatatcctggagtagttgaatcatcttgctaagcacctaattttgataaaacttgcggtggcacagtaagtttgggcacctaaacaactaattgattggctaatcacaatatacacgttttttttttcacatgtggttttatattgaacccaccgaattctcttgatccttctaacaaaatttaatctcaaccacaaaaataaaataataatatatataagaaactgtaatgtacaattgtgattagcaatgggtcatctcatctaattatccagataatattgtctatatttttccaattaatttggtcgtatgtaactaaataatgcattaggttgagctaaataaagtattagataaccttacctactaacaattttcaatgatttttttcagtttctatatttctgctttgtatttttgtgtaaaattgggtttacagaccaggggatttcgaacagggtgatgtgttggacacaaaatttattccattcatgtgcgagttattattcattgaagtatattaaacttttgttttattttacttttttctattaattttaattaaaaatttgatgtgaaagaaaaaaacggtattttattgtgaatagtaaaagtcatgagcaaaatcatcaacttaggagtgttgaaaaaaggctaaagaagagtaaattagaggagagtcaaagattgtgtgtcactagtgttaatgctagtaaacatcagctcttttttttcttctctcttaatttttcaaacatttgatttctataaaccttcttaataatttcttccgtaaaataatatgattagtttttttttttgtaaacaagtgcccacttgcttgaccttcccaaccaaaaaaaacgtaacaatttccatcatcttctccataaagttcttacctttaagtgtgtttaatggagatttatcctctactcatctctctctctctattctgttccatttattaagctttcttcacgctttttaagataattaacagtcacgggttctaaaagctaaagggttttgcttcgaattcaagtgtctcccttcactttctctctctctattgctgctctgtttctgctgtcaattccctaagaaagtcctgatttttagggtgatcgagagaagttgaagaatcatgtttattgagtttccttttttgatccatagggtcatctaattttgctaattttattgtcatctccttcaggtaatttgcgatttctctttactctgtttttgacttgtacttagattccttttctttaacagtaataaacttcataaagatttcatttttcttcttatgggtatttggaatgatgaatgtagattaggttgattgttttgaggatgatgtggataatctttttctggatattattacaatttagggtcttgagattgtttgtaataagctccgtactttggtcccttattttcaattcagtctttaagatttcggtaacccttttatatttgatgcaatctccctataataataccttcttcaattgctgttttgccatttgcatattatttaactttctttgttggatcagtctgattctttcttaccaattattgtcttaatccttgattaagaaaaaacaaaaaaacaaaagac

SEQ ID NO: 4589 - DNA, 1921 bp, Arabidopsis thaliana
tattgtagtctcatcacaccacactactaacgacagattcattcttattcatctcaaagtattcgccggcagaacaaagcttagataccgatgagctcaatcgagctaatgtaaatagtttatatacattttcagctttgctcaatcaaatcaaaagataaaacttagatcagagctgctctactccgggattttcattcaatatggtccattttcttcgaaactcagaaaatctcagacttagaaaaaaaatcatcaattatgaccagttctcgttcagcaaatcatgagcagaaacaagtcaataaaaaaaacatttgacagcaaactgctcgaattcttagttggaaaggcacatcaaaattacgaacaaaacataaaaatatgtttctgggaaacatcgaaatgaagaaactttcgaacaatcatcaataaagtaaaaacacacacacatacctcgtcactccatgatcgaggtttctccctaataggtctcaatcccagcgcttgttgcgaaatcgccaaccaaatcgataaccataagataatctgccactcgaagaaccctaatcccaaatgttcccgcttcttcatatcactcacaacccccaaaaatcccttctttatgactcaatacaaaatccgactggatcagaactgattcgagtctagctcaaaaacccacataactgaagaaagaaagaggtttgcttcaaatgaagtcaaaacaaaactaggctttggttttggttgtgtaagaaaacccaaaagacagcataagattcgtagatgtatcagacagcagatagaaagatgattacagacagataaacaacaacaacaataacaaccttaagatgcaatttgttttataaaaaactccaattgatgaatttgggcaattgcggtcgttgaagcttctcaatcaaacgtattcttcaataactcaattgttgaacaagtcgaaacttctttttggtctctctgatttttatttttatttttatttattagctttttctgttataaacgaaggaaggttcaattgataaattagttagttgaggtttcatattctcaggtcttttctttacgccttaaaacttcttttttcctcaaaaaggatttgtaccaatctattacgtttttttttggactaaaacataagtagaaatttgtatatttcgatctcacagtttaggaacgatcatcaaatatttaattagatccttcacccccactaaatcctcattatagaaagtaaacaatttctaatattgtccaactacagtagttgatgttttaaaagtagaggagaaagagtataaaattaggagaaagattgtgtacattgtgtaaactacaagacaatcaaaaaggattcagtcttctactaatagttgggctttaaaggtagaggagaagaaactgcaaagcctttcttacaacatacccaatccatttgaaaggcccactaaaattttattattgtatcactgggatatttatcgatttgtaaattgaaatataaaataaaacaatatgtaacgtaagttttaaataataataaatactaaaggattacaattttatatttgatggctaaataattacaagatctgagtgagaaatgtttgtttgtgagaaagaaagtgaaaaattaaaggtagatagccgttaagtccactgcatgtcgagacgtgttcaaaagaagacaggagcaaaaccaaaacgcttctacttaattcgcatttctttaggtaatcgatgcacagcccaaaaagcttgacctaacggctatgttttctttactttcaccataaataagcacctcttgaggttgcaaacacacacacacacacacactcacttcaaaagagttagtaagaagttggggtttgattaacgttttgcatcggag

SEQ ID NO: 4590 - DNA, 516 bp, Arabidopsis thaliana
acaaatggcgctcgagttccggtttagtgattagaaaccatcgttgttagtgttttgtttgaaaaactgagaccttttagctttctgttggtgttttacggttggattttgcagtagactgctcttatgaatggaaaattgtttgagacaacgctttactttcactgctggattagtgaaaagtcagaataatcacttttgctaaacatttgactaattatttcaagagttgaccagaccgacaggtccaagtattgccaacgggaagcttctgtgattttgcaggatacgtgacgtcggcaatgacgcgtgcgaagaacaaattaaaaagcatatatccccttaaagcgacttcgcagcaaaacctcttgtctcgtttatctatataaagaaaatttagtagcaaacttctcgattccttgattcgtgggaaaaagaaagtctagatttttgtggattttgattttgtgattccgtgattgtatgaacttgagccgttttgcttcgagattaaga

SEQ ID NO: 4591 - DNA, 2000 bp, Arabidopsis thaliana
atcactttccttcaccattattgttttgaaaatcttcttctgacttacgtttttttatctttaaaatttttaaccactcttcgtatttttttttttaattttgtagataaaatatcgatatcacaaccaacaaataaagttactatgcacaatatatgatgctaattgtgaaaatttgtaaaccacattctgtgcatagtgattttccaaaaaaaatcttgaaaattagactagttagctaattagtccataagactaacgagtgtatgtgtggcacagtaacaaaacttggatcaccgcttcgtgctaacaaggaaccaagtagctggcctacttatcccaacatcttacacagttggcaatagagtaacatctaaaatcgtgtgccaatttctgattaactacacacattttcgtgtgtgtattttttatacatgtcttaagattcgaatgtagcaagataaccatagataatgatggaccaccattcaaaaaggccaatttattaccaacataaatctacggccccaaattaatgttgtcacttgtcactttattttttatttttaaaagaaaaacatattaatagaatttcatagtaataagttataacaataagaacttttgagttttagcttgattcaaagtttttagttctactattcttaaacatatgataataaaataaatctaaatctctttaagttgattatttgttttttccatacaaatctgatatctctaaatctaagtacttagcaaagatactgccaaacatgtgatttcgctttggaagaaaacaaaaactcaaatgtataaataaagaaaaagacatgcattaagacacaaaagtctcaataaaaaaaccgtaagatattttctccatcaataaactttgcctttaattccatatagtcagtgacaaaaagaagtaacatagagaaagaaagccaacatatgcatttaacttagatatttaagttcgataagagtaaaagagtagtagatatttctttttcggctgtcaaagctaaaagaagattgaaaataatgattatcatttttcaacgagaactaaaatattcgaatcaaatagatgtaacaatatccattaccatccatttcaatatcgatcgaaagcaaatacttcggttacatatctcgtattacccaattcgtgactaatcataataagaaaccacttgtctaacaaatttgcttccagcctttaaaatatggttaataatgacgtttttacattaataaattataacaaaatcaggtttttttcagattttcatagagaattttttataaaaaaatatggtacatttttttatttataatcgcttctaattagtacaaatattgcgtgtgttattctttttaataaaatgttaaactatattcaaatactttttacatcagcttttttaatattttgataataaaaccttaagcaaagcttagaggtcgtcggttcgaatgacgctttgaactaaactaatattacatgttatggtttcggacatggaaggattacgaactttgcctcagaaccttctcatattcaaaaaaatatatatatatatatatatatattttcacttataaaaattcccctctcccattttcatactaaaaatgcactatatccgaatataaaatttatcactttcatttccacaaattcgcttcaagttaataaacatcatagtaataatctttacaaatttaatttcttcaactctgtattatagtatcactttataattttatattttttaaagaactcaaaaattgagaaatcccatcccaaatttatgtcatccccaagagaagaagacagacaaacaacaacaaggctagcgcgtgaagcccacgctcactgcagctggcaacagccaatttccctctcattctttctcctctcctttaaaatcatcaaatctctcaatctcttcttcacttgccaaaaccctcactcttaaccattaaca

SEQ ID NO: 4592 - DNA, 1975 bp, Arabidopsis thaliana
cttttatgttttgtctgtcgtgctagatttctgacttctgataaaccctttaaatatcgacggctttcagttgcgtgtctgaaaaccggttttggtttggtaattttattcaattactaatttaattgagaataagcacatgtcggtcaccaatgatacttgttaatgcgttcgatttttttaatctaaagttctgaattaagaaaaacttaattacctttaggaaaatacacactattatgtcctttttgttagataaaacatgtctctcatgtaaagaaaaatgcaagaaaggtcgaaggaatgctttgaagtttttttaaaaacatatgaattgtcaaaaagatgtattaaatgttaaccaactacataagccaatcatatatttgaaagtgaggttctatacaataaatacaaatggttcgttgtcaataagatagagatatgcacaattcttaccgaactattttggtattgaactctatatattttcttcaactttcaattgagataaagaaaaaagataatgattataaaagaatctcaacaaactaaatatacacatcccagaatctagatattatcaactaatgttaaaagtttcaatttatgataactgatataattaatgcttttttttttcttacttgataagataaattttatatattctataaaaacccaaatgatcaaggcaagcgtttaatctaaattgaccttaaccaaatgagcaaatattgaccaaaggaaatcttttctatttttttgcgtttatcctaaaggaaatgtttgtttcatggcttcaaaagggaatataatttgagcaaaacaagtaaaaaagtaacaaattaccgttacagcaaaaacaactttaataaataataacagagcatatggtaacaactttattacccaattcaaataaagaaaataataaaccgtggtcaaatatttgtatgaattatatgagatagcacggaacaatttattgatgggatttagtagttgagctaaataaataaaaagcaaaaacaaataaaataaaacaaaatactaaagaaaaaaaaagagtaaaagctgtctctttagctctgacgttgtttcctgtcgaagtcgcagactcgtcatcacagctcaggcgagtaattctgagtttcttctatctacgcgcaatatctctcaaaggaggcctcttcaaaggtaccacaatcatatcctctcgtttctatctgaagaatcagagagaagagatatatagaggatgcctgtgatctccaaagcttcatctaccaccaccaattcatcgattccttcgtgttctagggtttaatctctcttcctcttttttactcttctctttgattcagtctttgcttttgataattccgatctggttttgtggttggtaccagatttagccttttttgagtttattcagattttcactataccgatcttcgtttgtgtgctggaaaattgtttctgtggattcctttgaatgtgtgctagtgttactgattcgatcataaggctcaattactatctgctattgactggtttggtgaaactggcggttgaattatctattataagcttctatgggttttttttttttgtcaactgtgtttagtagtctttgtttggctatcttatagtactattttgtgtcagattatgatttgttgattgaatttcatgaaacagattggaggtcagctttgtgtgtggcctggtttgagacaactttgcctcaggaaaagcttattatacggagtaatgtggttattatccatgccactgaaaacattgcgtggagctagaaaaactcttaagattactcacttttgtagcatttccaacatgccatcctcattaaaaatcgaactggttagtatgcttttcatcttgaatctactggttgaaacaactctgtaacaatctgctgaagatattattaacgatctattttactgag

SEQ ID NO: 4593 - DNA, 1645 bp, Arabidopsis thaliana
ctttcttcttctgaattctgatatttacatgattctcattgttctccacaaacacagttgcttccgacacgccccaagatcaaaacaccctgaagtcaatcgaggaagctggtgttaaggagaaagtcatttcagaaagtttctgttcttcttattattaaggaaattcactgctgttataaaacatcgtataaaatacttatttgcaggaattacggttattataaatttatgcctcagattcttgatacacaagtttcaatactcaatagtattgcattattatgagatgttgtttctgctacgcaataactagaggcaaaatccaactacatatatgttttgatctgattattataatagactttgggcttcattccgcctaaagctacaacttggagtctgaagagcatccatgcatcgtggaacgctcattttacactgaatgctattttttattaaatatgaaaatcctcgatatttttctataaaaaaatatcttgaaagttgttgataggcccatgcatggatacgaagattttgggaatttaattccgaaatgtaagatttggtttgatttttttgttacatttgttcaaattagttttagattaaactctaaatttaaatcataagaaatcatcaattttacctggataatcttaacaacttatcattaagatctgttataattattaatttgtaaacttgagttaagttcgataaaatcacttcggttccattcgtttcaaatgtttccagtccaatgtcatgggtattgtttaggttaggtgtaactgtgtaaggtacaaaatgttgtttggatcaattaacgcaaaccaaactctcactgccttttacgattccaatggcaatatacattgcttctttgggatttcttcacaatcccgcaaggtttaaacttcctctgtccagtgtccccccaaaaaagtgcatattacattcccataactggcgtatatacagagcaacagagaatatcagttaaaaacggtgtgagcaaaaagtgcttcggttaagtattaaaattggttcgaaccggtgaaaagtgcaattgggattgcgtctctttgcatccaaaggacccaaacggacccctcatcacctatgtatcaaccttcactcgcttcaccggagcgtgcactttcacaaacgcggattctcaaatcaattttacttctttttaaaataatgttaaaagaataaaagatatatttctcataatacaatgcatgaatatactacaaaatccttaattttcctaattttctaaaagataaaatctaataattcgctgaaaatggaaaagaataatattttgaacaaaataatttccccattgttgcctatgactagctcgcacgttttaagcctaatctctcacgaatacataaaaataaaattaaaactcattgaccctttgaccttaaagcgcgtacctaacactcgcttctattttctctcttccctttatattacaccatcgaaccacttcatatcaacccttgaaaacttcactcgtcacacattcgattctttcatcgttgtgtctattataaatatatgtcaatttggtttctaaaaaattctaccattgattgattgatttttttttctttaagag

SEQ ID NO: 4594 - DNA, 1123 bp, Arabidopsis thaliana
ttgaatttcgagttcttgtaaacaacaacgaaaactgaactgaaagagaatttgggaaaaaacaaagtgtgaatgaagctcgtttaggtcgcagtcttataacgttttataactaaactagccgttgtggctcctctcttgcaaagtggaagatgagccgttgccgttaccgttccgttagtaaacccacgaattatttttcttccaaaactagccgttggatccgttctctcatggaaaaagtagacgtctttgttctgtatgggcctttgactaactaaatggcccagcccgttcataacattaatcatttaaaaaatcacattgatggtataacactaattttttttttcacaggtgtataaccaactaatataaatatgcacattcacttaaaattaactaatatcataaagagtattatggcgtctgttttattgtttatccataactacatcaatcaaatccaagttgatatactagttagaacctaatactttacaaatccgatcattaatttatcttgtctgcttaagattttttttttgtgaataaggtttaattatctcatcaatacgatttagtaaaaagtctgtgcaaaaattaatgacgattgggatttttgtaacgcaagcccgtaccagaacatgtctccgccacgtgatttctccacagaccacaagcatttttaagacgtggctttctatcaaccgttaaaaacgtaaatcatattaaccatgtgtctactacctacggtgtaaacgaaactgtataacgtccctatcatataatagtaatgtgatacgttggaatgtagccaaaaagcataaaaaataaatagataattaagtttataatgttttcctacaaaatattattataccgtatgtattttttattttattttctgaagttaaaaacagatgtagttagttgagtaaattgtgttctagaaagagaagagagagcagtagtaccgtggtaggtagctagcgacctcttcgttcgtcagtcatcacaagctttgaaagattttcagctaccactctctcctttatatattcattacacatctcttctttctatatctctcttaatttagtcttttgtcttcgtaattaca

SEQ ID NO: 4595 - DNA, 1438 bp, Arabidopsis thaliana
gtcaaacttcacgatttacgaattaattaactaaacaatgtattttacttaattagcaactaaacaaatttatggcccttaaaatattcaaaaaaaaaaatgtcaattttcaggcaacctaatttaatacgagatgtacttgtttgggtgtgagttaagtaagctactgatttttcaagttgaagataaacctgcttcctcccaattaaaacacacatttacttaaatattgaatatgattataacattattaatatttttttgaatgtaaataagtcatattagttagtacttaatagcttgatcatccttaatccccaactttgtttcaacgttgaaaatagctccgcgtgcacctttacaagtttagtatcgttttacttacaaagtttatgtagcagaggtgtcaaatttaggcgtcgataaacatctaatgtatatttatctatataaacgaaattgggatatagaagtgagggtgtgagtgagaccatggcccatggacgtatgtagtgtgactcaaaaggtcaactaacaatttatttaaaagtaaaggttagttacttagttatagagttcaataccaaatccataccacaattttcaactcccatcgaaccacttctttcattttttattttcattggctggttttgtattgcaaccgctattatgctgcgcgactcattagctaggttttctagtttacgtataagaggatatgcagaaaagaacaataaagataacccgaaaactttattgtattttagtttaggactaaattaatttgaagaaaagaagagaatattatctattttaggatataatatagaagtacgtaaattaaatgtatacgccataatgccaagaataataaaaatgaacttatgcaaattaattttaaggaaaaacaaaaaaaaaacttatgcaaattaaaaacgtgtatcgttgtatgctaagggaaaccgaagaagatacatatgtttgaacgtaaacattaatttcattagagaagaagaatgtgaagatcttctaagtgctccaacttaaagaaaaacatcaatttaaatcttagttaataaatatcatttttagctaattcttcccaattaaaacaaacaaagtaaaacaagaaatttttgatttgcatgatttttaataatcaaataataaaggatcctagtttcgaattagtctagtgggtgtaccgaatcaacttaacccattgtgagattttcttttttttctccctcctgctgactctaaacctaatattagtttccactttggtaaaatataataaattgtttaattgctaacgaattcacgaagacctctgttgtttcccgcttagtgtgtataaataccactccttccttttctccaaactcatctcacaaatctccaacacagagagcttctcacagtgaagcaaaca

SEQ ID NO: 4596 - DNA, 1726 bp, Arabidopsis thaliana
gtccgcttaactcgtctcttgtacgggttgatgtcttttaggtgacaggtcgaaacaaaacaaaaaaaagtgtaaaaccatataggcagaggcctcttttgtttgttttttacttttacagtgggttttgcctagttactactagtttttgagtttcttaaaagtggaatcactcgcacggttcgatatgatcatttctgattcgtcttcttttattaaaatgaggagaatctaacgtatatgaatcattcttgttttgaaagtgatataggttatgattggtgttactaccacatgttagaaaatcgtgtaaaagtagtactaaattgaacatgggattcagcgatacagaattattgaacaaggcagaattgtttttatgagaatgatacatttcttgctatgatggtgcaataatgggtttctcttttcgcccaaaccttatccttttttctttatcatattctcataattacattaccctttaaagcatcccttctaaattctggattagtctgtataatatcattcattagttcaccggtttataaaaatcagaaagtttataagtttcaaaattttgctttggtgaaaagatcattcatatggttccaatttccaaaccattaatttaaattttagctcatagttgtatctcttcgtctcgatatggacaagggatcccaaagtacattataaatataaaaactatgggcatgggtcttttgacgcatacaaatttaaaacaacttaagctttagcctttgttctacctaatttagtaaattattagtataaactataaaggatctattatattatttaatacaagaatgaagaaaactatattatctactatattcgctctttcttttttttgtcaaaatggaatgctgatctggccactctacataactttcatctagcctctcatccttatctagataaacaaaatatgtggccctttgataggaaaaaatttcattcaaaaaatgcaaaggcagaataatttaattttacaaacgaatgttattaatgcagtctatagtctcttcggtataataaaagtgattccttttctccaaaaactattttgaatgatattaaagctcttaaatagcaatacactaaaaacgtagcttcattaatcaaaactcggatctaaatgtgtacttagtgaatgatattagtagagaatcatatccccaacaccgttatctctccgtcatctcatcgtttgtttttattacaaacaaaccccctcgggatcacgtaggtcccactatttttcctcttaactaaaagggtaataccgtcatttaccacacctctcgccgtcactaacacggagagagaaagaatcagacagctcatcccaagcacacacactcatatcagaaaatacacagacacaacacaacactgagagagagcttttcttttaaattccttcaatttttttttgttgttgtaaagaataataatttattcgattgaatttgtttattcgtgtctttgtttttactcaatcccctgtttccggttctgttcgattcttctctgtctctgttttgtttttcgtcattttgcctaaagccacatgcaacagtgattaactgaatttttattatccatatccattttgattcgccggaaagtttattcttttccggcgacaaatgcgaaagattcgaaaacccattttaaccaaatcaattctatgacg

SEQ ID NO: 4597 - DNA, 2000 bp, Arabidopsis thaliana
ttttcaataattgaggctgtacgttgtgtattttaggttttttctttagattgttgcatgttatattttcagtttactatatgttgtgatgattattcgttacaaatgttttcaaaatgtcatactatagtagtcatttataatagatatgaaaaatgatcacagttgatttgtttttttggtggactacgaataaaatcgttttggtaattgtctaatcttcgagtgagtaagacaccgtcaatcaaccatcaatatcatcaatcaaaaccattattgatctattttttggtttaaggaaaagttggtaattgtaaaacgacttcaataaaatatttaaaacaaggagaccaaaaccgacactcggaccattgataatagaaacaacgagcaaggttatagtagtatagttgagtctcacaaacgaacacgtaaacccaatataataactacgcaaggttacatctagagcttattgttcccatcacaataacctcttggcattattaattatcaaattcactcaaagtattaaactcctgatgtctaatagattatcaacaaatcgacaaaaatgtagatatataactcaaaaggtataaattcaaatgtttggtggggttacgtaaaaacttgaattattaagaactaacaatactatagtttaattaaaaggagaattatgaaccgttagagggaaggttagggagcgtgcatgaacattacctgacgtttaccgacctgattcgtaccgtacataccagaacaaagagcttttaaaaacccgcgttttacgaccgacacgtggcagttcttaaatggatgacagttagtgttttattaattgtttttgtttgattaacaagttttatacagcctggctgtttctattcgtattttcgatataataattaaatatatttcaggaaacaaaggcagtgatgattttgcgttccaattcggcaacctatgttgtcgttttctgccacgtcaaaacctcctatcttttgttaaccgcacattttacatcacgtttcctaaaccgaacattaatatctaaccatttttatacattcacttaatatcgctcacacggttctttgtcaatcccattttaatccagcttcgtttcaaattattgaggtttagatctttttatgatcatagagcaactatatatagatttagtattgtcaatttgtcatgcactgttatatgcatgaattaggtgtttgtgtgttgtttagtaattaattataccttcttagtgacaatttgttttctttattagtaatgaaatttgtggtcaataattttgattagttttcaacccggaaaatcggttatatgtaaagtagatattatcataaagtttttatgtgaagtgctatacagcctggcttcgctattctaaagtcaagactaaacataaaaataaataaaaactgtccttacccaaacctaaccgttatcatctttttatttttttcttcagatatttctttttcatttttatttcccctataaaaaaatttaaattcacctcaaattgtgcgaatattatcatggctttgctagttgggtttcgtgattttgtctctttaacttcttactttcgccacgcgcttaaatggcgcgtgtactcacaaactcatactttgagactcgactgatctccacgctcaactatacgaaattgctgatcttgaacaaaattattacgaaaacgacaaaaaagacacatcgacgtagtcaggcttcgacgcgtgtccacttacagctgtaccgcaaactttgaaaaaccgcttgcgtggaagaagcgttgcccatgacttctccaccgtcttaaccggtttccggttatcctcctctcttaaatctctgtataaataattttgtcctctctttagtttctcgaacttgtttttggttcatctctcaaaaccaaaatcactaaagaggagaagattgctaaagtttgataaaacattccaaaatca

SEQ ID NO: 4598 - DNA, 1226 bp, Arabidopsis thaliana
acgcgacttccactgttgccgccccacgtggcagctagctgattttaggatcaaatctaataccaatgcactaaattaattataataattacttaacaatctacggattatcttcttacttcataagatccttatattttcattacactttgactcattcctttcaaattctcatattcactgattgaatacagtacagcataagacatgtgtttaagtgaagtaaacgctttactaatcagtaatcaaggattcaactagaaaaagggagccacagagacaaagactatacgcagaccaacgtcaccctcaacctttttctattcacccaatgctaaagaacaaaataaaaaaaaatctttccattgtcaaacattaaaaagtaaaaaaaaaagttcttcatcttcctcgtcctcactttattcctattccgtgttttttcagcgttttccacagctaaaaaccgacatagcttctctatttttgtttcctgggtgtatgtatgtacagagaataagaccgatctctccaagatctctgttttctgaagagttggtgaatactgtttaagcttctctataagagtgtcattccaaggtatctcttacttctctaatttggtgtttttagctttgtcttcaatttcttcttcaattttaatttctatgtatttgagtaatctataagttagattgcttatacagaaattctaggaaaatggtatttctttgtcaaaaagagacgttactgcaaaaaaacacttctttttctgggttttgggtctctttgagattttgatctaggagttgaattgaattgaaatcttttcttaaaggttctagtcactgctatactagtgcataaattctgttctttttattgattactagtaatatgaaaatgagaggaacaagagacgtattaaggtatgatattaaaatgtagagatatatcttcactctttttggaatactctgaaaatcttatcttaccaattcctctttaccaatttccttttcggtaaaatgtagaattttttatatctaagaaatataaatttccataatctgtacatatatcacacgctttttgaatgaatatttttgtaggtgaagtttttgatttcaaagggttcgaattgattttgcaggtgaagaagaagcgtttgattcccaaaggagattcatttatttgataaatagatttaagctaagagttaaaaaaag

SEQ ID NO: 4599 - DNA, 2000 bp, Arabidopsis thaliana
cacaaaaatccccaatcttgtgtaaaatactaaaatgctttaaaacttaccgtaggaaaactaaattgtttttttcagtttatttggatacatcagagtgtcgacattaagtgcagagtattgatattcacagaaattgacatctataaaaactttaagatatgtttaccaaatctactattaacgaaaaagaaaactactactagtgttttttgtttccaatatagctcaaatcatttttattgtcggccgtgttatgttactattttaatttttaaacaagtacgacaagaaaaaggtggcaaatggatgaaaaagatggatatcatattaaataaattataatgcaaaagttaaaatcattcaaagacatgacattaaatttgagtcgaatagagtcttcgttcttcttctttttttttttaatcaaaaaaacatagagctttgtttcatgaaatttatggagtctgtcaattacttatccatagttcttacttccatgtggatttgtccaatgttgtgtctccttctatattaattagacttaattcttttgataaccatcgttttcatgcaaaaaaatccagggtgtattttacattgttattacatgatagcttaacatagccaaatattgcatcaaaacggaatgtgtgagtttaaccttgccatttatatcaatagttttttgccggagtttttcaaagttgaagtatacaattggctctattaattagtaggaatctaatcaacttatatgctccatagccaaaaccgtatttttcacttagaataggattccaaattttatttttataattagaaaatattttgttctaagatcctaattatacgattggataatttttttgcacataagtaacaaatagctcaagagttgggacctgagacttgagatggtcctgtctagagcgatttagccaaccaaaaatggttgtactacaaatgtcaaatgacactagaatgcgaaattgcctcatagaatctttgttttttttaacgatgtttgctagctgggactaatattgagtgagaaatgatataaatgaagatggggataagaactattcatcgaacacgacttgtgtggtgtggataacaaaatgaaagctacatattcataaattaacatagacacatccctactctcacgcctctccacatttaacaactttcatatctttattttcatttaaaaaaaaagaaaatcatattagaaagttcatgcacaatcataaatactgcacctatactctcattgattaaagcaataatgtataatttattggaaaaggagcaaaatgccaaaatatgtaagaaaattaaaaaaaaattacaaatttatcatctcgaatgagaacaagataaactgtatatactaatgaaacctctttctatataacaaacgaatataaacatgtatttaaggaaaaattaatctaagaaacgatcgtgtggcaacaaataataaaatctaagaatctacgaaagatacgacgatcgtatcatatctgcgagacatagcagagtaatgtaatgctgacacgtgtcccagtaaaaccgcaccacgcctttcagttatgctatacactgggaaattcttatgcttcaatcattgcgaggctgagagccaagaaaatattttagcttttatcacaataataatgtgaatagttctaggagaaaaagtacacagaataaattgaattctaaaaaaaaagtgaaagaacagtaagattttggaaagaaaacaaagacatattcagtgaatttaaaaacataataataacaacaataatagaaaattggtaggtccaaaatcattgtgacaaatcgatcagtgattagctgtactgaaaatctaagctctaaatgagaccgttcctcaataattgtacatacatttgcctgcatgcatctccatataaatatgccttcgatcttctacttccaaaacaaactcatcatcataagcaaca

SEQ ID NO: 4600 - DNA, 2000 bp, Arabidopsis thaliana
caccagcctctgcttagggccggctctggttcagctaattcctatattatcaatattcgttcagatatttgtatgttgataactaaatttgatatttgtgatttttctaaaaaaataatactaaaactaagtgcctgcattggcaggggccataatgctagttatcttctatattagagcgtaagtcaacgatcctattctgtaaggtctaccatctagaattgtaacaatttcgcaatcatccagcttttgctgacccgcccgccactcatctactagtcgtttgtatcacaattccaggtcagctacaatttggccaagttacttctagataagaatcctctggtctaaagtcctctcatattgtacgtaacttacaaaattttattgcaaaaaagaaaaccctctcataattaaataacgacacatggatcattttcaactagcaatggcccattgctagttgtttttggtagtatggcccattaacagtttgatttaagacctgtttttaggaaatttttccaagaaaactcttcaattatctttttataaggaagtttaatacctaatatttctgggttggaagaataatacatatatttataaaaatatgtaatttaacactcaaacaattaaatgttttatacttacaatctcataacaaaaaataaaattctaattaccgttaccatctcaattaattattaatttttagatgatttgacattaatttataattttgaatataattttattttatgttatctcaaaaatataaaatttcatttttatcataattaatttattttaaaattcaacataaaaaattatgagaaaatctaaatactttaaaatagtcatttttacaatcttatttcatcgtctcaatatcaaaaagatgttttttcttgagattcaatcttcgattctagatttcctcaattaatcgctacgagaatcgctgataaacaatttttgtcgccctcttttgccaacatcaaattcgataaccgttcacaatctccttttaatcgccactaaaattaatttgatttcattcgtcgtaatgaatatgatatcaacgaccattgatatgaacttcttcttcgtcgtgagaaactctctattcgaatttaaatccttgacaaataaacaattttcgacaaaatctcaatttgaatctcattgtatttctcatgatttttcaattcataaaaatggctaattttatttttacctttttcaaagttttttttgcttttttcttgaatttaaaaaagataatatttttttataaaaacttttgggataatatagaaactaaatgttaataaaataacttttaaaaattaaataaaattaatgcttcatcacctaaacattagtagttaattgagctagaaatggtaaaattggaattgtatttttgttctgagattaaattgtttgagtattaaactttacagttttattagtactgtatgtgtatttttcttcgaaccggaaagtaatgggtagtaaacatccaaataaaaaaataattgagttttttttgagaattttcctttcttttattaacatattttactttttttgattaaatttttttaaaatatatttaaaatctttgtagaagcacactaatccatttgctaactaatttaaatatgtttctaacatgttcacatatattaaaaggcacgttttgagcatacatatattttggttctcagttcttgatcatctagtgcattatctctcaaaaaccctaatcatttggcctcttcttttccccctaggctaatttacatataatatccttagaacgaccaaaacaatgtgccacagggactaattaaattaaacagcttgtaaaaattgtaattatcttggaattgttggagttggttaaaacactttttagaggcctttttattcccatctccgaccattccaccaaaacccaaaccatttttgtttcgcaaaatcattctacc

SEQ ID NO: 4601 - DNA, 2000 bp, Arabidopsis thaliana
tttacggtcttgcctgcagcaccgtgatgagaggcgagggcttggagggatattttttgatgatttgaatgactatgatcaagagatgcttctgtcattcgccactggtagtgaccaagatataacttgtgacattttgttttaagaaacttcctagttgacttatttgaatactgagatgaattttgcagaatgtgcaagctcagtgataccagcttctatacccatagtagagaaacgtaaagacacaccatttaacgagcaacacaaggcatggcaacagctgcgaaggggcagatatgttgaattcaacttcgtaattggatactactagctttgtttttctttctgtataaatatctcttgaaacctcgtctcatgttttgttgctgatggtaaaaataaaggtgtatgaccgcggaacaacatttggtctgaagactggaggacgaatagagagtatccttgtctctcttccgctatctgcgagatgagaatatgaccatgtaaagtttcttgattcaagaaactaaatcttgtttcatcttagctaatgaaacttaactactgatggtgtttgtctcttgttgcggatgcagaaacctgaagaaggaactgaggaatggaaactattagatgcttgtatcaatccaaaagagtggctttagttaattaattgtggttatttccccaattagctcttttattagttttgtctttaaaagccttaaaagagtaaagagtctaatgaaaagtgagtgagataaagaaattgtaatttggcgtcatctcatcatgagtcactgacaaacaaagatcatgatggttgatgatggagtatatagtaccaatcgtgatgatgatgataaaagtaattaacttttaattttttttactgacacagtaaaaataagagccgttggctcaaatagccgagcctctcggtgcacgcacgcatgccacttgctcggtaactgttcactagacagaacacaacaacactcaaatagagtgataacattgaatctgatgatttggtttagtataaaaatcgtttccaagtttcaacgagtgggacttgtgttaggttaaacaatttcggattaagtaaacgtcactgtctcatttgtcttgatacaagaaacgcccgtgatattttttcttcgatgtcgtccaatggggacaaagaaacaatttagtccccggatatacacacacacacacaaataatacatgggtgttgttattatggcttaccttacacaacacaacttgccaatgtttttaaatttactaaaaaccaaagccagaagatattttattgccacaaattgacgtcacacctgcccatatctaatccatgtctgcaacacaaaaaacaaaaaattgaattcccccaaaaagtgaggagagagatgtaaagactgtgtaccaattcaatatctttttgagcagagtaaaaaaaaaagtttaaaaatttgagcttctgacacaaaaggagccaaatgtaatagctggatccaatccaatgcaatgaaaacatcttagctgtaaaatggtccaatctctctcttttctttctacattattacttccacagaatcaatttatctctcgaaaagcaataaagtctctatatttgtgctcaaagatagacagagaagcataaatacttgtcctctgtgtagtacaaaagtggagccccactgagtgatgccctcacagtaacggctacatttttcttttatctctctgtctctctcttcttttgagtgattttttatgaagatgggttcttttgtccacttattactgtcctgaatcacacgtcgaatcctacgtggcatctctctccattgtatgccagctcactctcactcactcactcacctcccgcctttataaagccttacctctctctcttgtctccttcattgagtcaagtgctcgagactgtagagtgaagtttgatttatttagagagataagttaaaaaaaaa

SEQ ID NO: 4602 - DNA, 2000 bp, Arabidopsis thaliana
ttatacacgagctaagaaaacaaaataaacactttcttaatttttatggcacaaaacaattctacgtattctacaacacaccaacttaaatattaaatatacatgatatggctcttctactcattgtcaagtagggtctattacaaattcgcaagtggagtgcttcattggctgcccgtgggttatctctgtgtctggagcatagatattttcatttcattaaatgtttctcgttgtcatttgtcgattgttcactctcttctattttcttatagctttcaaggtacgattttattattgtgtttaatacgggacagtactacggccttaattgatgtcctcgtccacgcctgccttgacacggatatggactttgaggtgagttctgatatgagcctctaccctccagtttctagctccacgaccacattctatttgtgatccactttcattctaacaaaccaataatttgagtgcatttttaattcttaacccattttttgtaattctcacatgtcacttgcaccaaagagctagaagaactctcttatgatgttgataattccaccaacttggtgctgagttctttctcaccattggacgagctccatgataacgaattaggtttccatttcatagaggctcttataccatgtaaacttcgaaacatttagagaacttgttattgtataacacacgtacacaatgctataagtcgttataccatatttggccgttccagtaaaaacatttttgaatggttttgctgatgatgccgtatactgaacgtggacgatcatttttcctcctatcaaaaacagtaaataattctttaaccaaaaaaaagcatagtaaggaatttcatgataaatttacagaaaccgtagaagaatatataccaatcaataattggtgatgataacgtcaaaaaaaataaaaattgatgatgataatcttttaaatcaccataattgtttccggccggaaaaaaacagataactaatttttaacattgtggtccgaatatttattagattgacccattctgtttatatatattattaaaacccattacaactttcttttacataaaaagagatgataatataaagtcggctttacaacgaagcaaagaaagaaaatgtaatggtgctcgatcactcttatgtgtataattaaaagcgtgtgtgtggttcatttcaattatatgtgtttggttgcattatgaaccataatattccatagccaactgtatcctccttgttttgttctcttcttctcctacatctaccaccgccaatctcgccttttttttccctctcatttatttattaatctactcattttttttttttgacattatctactcagtcctttattttattaataatccaatatagaaatttaaaataagttaattctttcaaaacttagaaaaatacatgattgtcggatttttttatttgtcaataacatacaagagtttgaatccgaatagcaacataacaaaattactagcacaaaccattatacaataatgtcggttttctaattttaattttatttgtcagatttttttcgtttttgacattgttttatattttttctaggtattaaagtttagatgttggatttataacatagtttttaggatttagatttagaatttaaactttgattattttgtcttataaaaatatagactaagactatttaatttcttaatgacttttcttcttttcgagactattccttaattatgatttgaaatatacactaaaaaaaaaagttgacaacaacaaaaaaagtggaccaagacgtaggtccttaaaacggtgccgtaacaaggacctctcgcttgacaaaatggtcgcgtgaataaataaaagcaacgttagtcgcttctgagtaaagaaccaatcccaaagctcatttattctttccttttcaattattctttcaatttttccgatcgacggaggttgatcggcgacggcgta

SEQ ID NO: 4603 - DNA, 2000 bp, Arabidopsis thaliana
tttacatttagataaaaacacataattctttatagtaaagaactaaagattaatgttttgtactttatgtactattccatatcaacatatatttgtattagtcttgggaaagcaaaaaaatttgaaagacttttttttccaagtatgaaagatttagttaaaaattttaatcagtaacagaattcaagagtaatgtttattacataattatatactttagaaacctgctccagttttgaataaaataaaataagaaaatatttgttcgaaactccaaatccagctgaattagttttgcatgtttttgcacgaaaaaaaagaaagaatatatagtttacgtatgaccatattttatgttttaattttaagaatttccatccatataatgtaaacccgtatattttgggatctactatcatgtaggctgtagtctctagctatagccaagaaaaaaaaatgacagatagattgacaatcgttataagaaaaaaaaaagattaatactcttaatcatacacaacccaaataaatattaaaaagatacttacgtaaatgatatgaaacttatttagataaatgatcaaatagaatcttaatctaataattagtaaaaagtcaaatacacatgtgaacgcgatggagatatctatatttgttgtgggaatgacttaagtcgactgtcgacgtcggaaaacaaaatttcagagtcatgactgaaagaaaattgaaaattccatcataatgttaagaaaaaaatgtaataaagtttttgcatgagtgttgattttccttttgtttctacaaagtcaagccacgtacattgcgtaaaggctgattttgatttataaattcattttagacttttcaatactcaactttctataaaaatatatactttattgttatctcaataacattgtgaaagctgtgtgttaccgttattagactcagtcattcgcttcgtcacttgtacaataaaatgtcgtcactcatagacatattaaatcctcatgtgatttttttgttagcctatcttttttttttttaataataaaacagcctgttttagttgcaccttcatgtgcgttttaccgactgaattggcgagataagcttcggattatagcaacaaagaggagatgtgattcgagtcgattgatatagatacgaatctatttgttacaatagtaaaaaaaaatataaaaatatttcattttcaagaaataatgtcataagaagtcaaaggaagatattgtcattatggttagtcaaataaaaaaattgtaagccagcagttacgttcatacctgctttccgttgacttttataataactacactagtcttttgaaatactccattacctaattgcatttgttccaaaaatataccactactagtcttaataaattgtaattagactaggaaataatttttatttgaccaaaattatattaagaaatttggatttttcttaataataatcagttgatagtaagattttatggattggaataattgatttcctttccaaaaataaacaatcatgagatcctttcataattattttacactcaagattcttttctattaggggagaacaaataaaaaataaaagtgtttcctttttttttttttttttttcaaaaataaaagtgtttccttcatatataaatacatataaaacttgcgttacccattttataggatctcgtgcaaataattcatacatacagacgtatcgatcttgctgacccatcaattaaattttgacccaaaaggtcaaattcactataagaaaaacagaattcatttcatcaaaattccatttcacactttttctgtctgttacgattcttgcttgatttctttctaaacaaagcaaaagttgtctttttggagttgtgagcaactaattctctgaaattgaggaagagaaagcgagaaggtttttttggagtcagagacagaagaagaatttaacagattcttgtcggaaac

SEQ ID NO: 4604 - DNA, 2000 bp, Arabidopsis thaliana
ttggagaaaaggcagggttttttcgaactgccttatgtcatgcctttcttatgctacacatcacgcacatacctcattttggtttttgtgtaagattttataaaaactagaaatgtgggaattctctataaatatattttaaaaaattatcgtgttaccaaaatgtgtttttcgttcgcaattgaactctagtaaactatgaagataattaatacaaagaaaatccaaatagtcgactgtagtagttatatatatatatatatatatatatatacatgtataaactttgggtactagcataattttccaagttagtaatattatcaataatcaagagtttcaaattactgatgatgtttttaggaatcgatcgactcgttgcatggaactacacgaggtgtacgaagattcttcgtcgtcgaaggacattgttcaagagatatggtgaggtgactttatcaggagtcaggagatatgaggtcatggggtctgctaggatgttttgttacatttcggtggacatcactaggacgtggtataaaaagactggctcaccttgatatagattgaatctagtggacctcatcctatagtagtaggcccggccataggcatgcatgcgatgctaagactcaaaaggtaaggcccatgatcctttcatctaaattcctttgaagcctaactttaagagtttgggtgatagaattgaggatttgcttctgagatatggactaggctaggattttaggcctctaatggctaaatttttgagaaatttcttcttcttccccctcttcattcttgtgagttgtgacaattctttttgacactatgttagcaaactctccaaattcttcttcttccaactgttccatgagaggattcgaggagactcatatattagtattacacacggttgtggttcagattactgtccactcccagcccagcccagccccgacatctcgaacattaattctatatatatttcgtctcttttttttctgtacgaacaaaatagtttagtatttcacttataaaattaacgagagtaaaaactacgatataatacaaatggccattaaagattaaataaatataaacatcaaaacatatcaaagcggactggttagttatgttacgttgtaccacctttttataactttttttaaaccgttttatttatatataagctgttgactaaactgaaaacatcaaaacatatatcttcctaagaaattggtgtgtctatttaaatttaatatctgagttaatatgaaatttaattttattgatgaatttgtattttgatttaatatctttattctagatacagttggtcatttctctttgcttttactatgttactttttgagatggtgaccgtttcaaagatgtttacacttttacttacttctttcaacggggtttagtataaaaaagaacaaaggaaaagtagcgaatactttttgacgcaaatataactaacaaatattttttgattcaaaagtatatgtacgtctttgaaggtttttttttaatcttttcttcaaaccacacgagaaaagacaaaaatgcttgcaagtcaaagataagaataaattcactcgtttcttgaagtattttcaaatagacactagtattttcttgaagtccaaatgttagaaaaagaagtttgaattcttccttgagtattagcgcgagaagaatcacaatttttatgaatatttacaaaaacaaagtggcaaaatatccaagatccgacatggagttctcggaccttattcacaaagacacaaaccatagctaactataagcgtaaaacgatcacttataaatatagagacacatatctatttcttactaatctaaaatcatttcttcttccacaatactaaaagcaattatcaaaaatatatcaaaaccagtcttcatctctaaatcactctttcgcttaattcaatcatttcatttcttcctcgtctattcaaaactcttcg

SEQ ID NO: 4605 - DNA, 845 bp, Arabidopsis thaliana
tttcttctttgatcttaaagttccaacttcggcaaatactaaaatcaacagtcagtcgtacaaagaaactctgcttatacagtaaagtcaatgggccactgttctaagcccatatataattttagaagcccatagaatacaaaagagtcaagaagcattgaccgcacaagaaaaaaacaattgttaaaaagggttggttagtgtgtatgtatatatgaaatgcaacaaacattatacagcccattaaatatggttgttataggtagatgtccccattaaggaactttatccagcccattaaattactttacagagtaaaagagagagagaagatttacagttacgttaccaaattttcgaaatgatttaattagtaataaataaataattaaatgtcagttactctctttagaaagctaaataagacagctgtttccaccaacaacgtgactggtcgtggggtcctccttcgttcaaagtgatattcagaaatcaacggctgagatcttctccatcaatatttattacgggcctattccttccttttttaaacttcaattctccggctcacattctcttcttcattcgctccgtttctctctcaaaaactacacacccgtaccacaccaccaccctcctcgtttcctcagagatcccctctctaacttctaaggtaatcacatttccataacgttccatcgtcattgattcttcattagtatgcgtttatgaagctttttcaatttaattctctttggtagatcttaagattcctctgtttcttgcaaaataaagggttcaattatgctaatattttttatatcaattttgacaggatatagaaa

SEQ ID NO: 4606 - DNA, 1709 bp, Arabidopsis thaliana
cggtggttagctggagattattcgcttggtcgattagcaggaggggaaagcaaacaagacctagaacctttcttctcttcttctctcgctctgatttctttttcacttggattctctttttctacatttttccaaaaccccccaattctagcaaactctcaagggttttaggcccattagtttttcttttgcattccgaattcaaatctaattttgtttttaggcccattagtgttttttcagcggagattatgtagagtagttagattttctcttgggtgaagattacaaacccatttcaagggttagagaactcgcttgtagtagtgtggtgtgacacagttcattcatcattagggattaaaccaactacactaattctgtctttccaacatgaagttttctggtaatgcaaacgaaaccgattatcttcgacatcaatgttcagataaagttgaaaactgatataatggttgctaaggagacgacaaaatgttttttgtggaagcagagaaactaaaacctgattcgttctaattgatgctctcaaaacataaccctgcttaaatgctgatgttcctaaactcaaccctgctaaatatgctaattcatcgtataatctatacatatcacctaatcttagttaagcaattaccaaagataatgcttcaccccaaggccattgcaagtcaatatgagctccttgtactcattcaatagttcctgcaacagaagatacacagggatttatcaaactcaaaagctttggaagtagtttctctctcgaatgaaattaataactttcgtctaccgtgttgtgctcatagatacgacgcatccttttcttatcgtactcctgccttgcaattgggtcgctcaacactgttcagttacaagatcaaattctttattgctaaagtccacagaatcaatggctaaatgaaaacagattcctttcccctaaactagtaaacttctttccttcaataatacattctgcattacatagttagaagaagaccaatgaaacaaattcacattctaagcttactactacttcaaagcctagctcaacaaacaaacacaactacatctacacgatgaaagagaagcaaaaccttgataagcctcgttgatttcttgaaacctagacgtagcagaatcctcttctttaaatttgtccggatgccatttctgcaacacaactccaacacaatcatcactgaagaactcacactcagagactgtcacaaattagtgggaaaatgaagtggaaaagagaaggaaccagagcaagacggataaagctggaacgaatctcatcatcagaagcgtcacagttcaattccagaactttatagtgatcctgcaacacccaattcacaaaaaccaaaactttaacaaattcaaaaccaaacaattatcaaatttttgtttttttgtttgtttaccttgtaatcctcgaaatcgaaaaaatcgaagccatggctgtctccccaatcggaacaccacattctccagagcaaacaaacgattccaagcttcctcaaatttacgattttcctcctctcgtcactgtgggcttcttcagataaaattttattattattatgcaatttcgttttagacccctaaactattacattattacagttaaaggacatttcgcagcttccagaaacatttagagacggctgagatacacagtg

SEQ ID NO: 4607 - DNA, 1477 bp, Arabidopsis thaliana
ttgaatgaacgaatgatcaatttaatgaaaacgcttgtgattgtttttcacttttttttttttccttttcgtgtgagttatttaatttgtaagtgttattcatatacttttctattttaattgctatacaaatgtatggtataataacaagctgagtggttatatactggcctatttaaccatttacatatgtaaggaacagtgatgatcaacaatatggatggctgaaaaactttgttatgtgctatgcaatttctaacgtgagatgtcgatccaacactttccactctacgactttttcgcaatgctatggaaataatatacaaattttcattgaatcgtgcatataatgttgtgatttgtccttactcttcattgcttctctttaccatactttcattgcattattggttattccttaatccgtagcatctcttctatctttttttttttttggatttatactaattcctgctaatgttattattaaaaatgtctccgaaaatatgtagtagcggatccgggtggcacggaaattgttaaagaaagttggtggtgagggtgagattggtgggtgactcgagaaagcatgttggcacaaaccgtgtgaagatcgattccgaaatctccacagtaaacgaatccatcaccgtctttcccgcaagcgtcgcagcggaatcgcccttcttggtatttgggagaagggattagatagagatggttagggtgtctgattttttgaggtaactcggaacattttctgtggatgtagaatttgcaaggtttgcatgagtatgaaggaagatttaggagttttagcttgcaaaccacaaaacaaaaagatgaaaaagattggtcttcaggattgacagataagtggaacaaaatatgaggatgactgaaatgtcgaattgagtcctccggttttggccttcccattgtgttgtttttgtttttgctgcacaaattactggttcattagagagattttgcaagttctaaaatgctatttgtaatttggtatatgtgaatataaattaatggcttggattgatttgttggcagactttgttttgtggtagtcatttattctaccgtgtgaatgttaacagtgggatctacattttcagtcgacgacttcgaaagtcaatggttatattctttgatcaagtccttatccacttgaattatatatgggaagctcaattattgatgaattctagttttgtcactatttcctaacaatcaccaaaattggagatttttaaatcttatctctggtgattgtttcgtacgtgtccaagattatgcaactctaatgtcaaccgtcttccatatattaaactacaacttggtgaataatcaaaaccaaactgagaattgtttagcggaaaatggaaatgacaaatcatccacatattttgctatatatattttctaaacgtttcttacactgaaacaaccaatcctatacaca

SEQ ID NO: 4608 - DNA, 2000 bp, Arabidopsis thaliana
ccaacttttgtttcccacacttcaatttgacaccaagcaaaagaagcttcggatatcactctgtgagataaagttagagaaataagcagagagtagttaagagaaagatcatcagcttctttgtctcaagtagaaaaatgtcgacatgtgattacaaaatcatcaagaccccgtgttaaattcgttatctaatatatataaaaataaaaaggcaaaaccaacttctgcgtcggtaccaataaaaccacatgaatagttatgtctccaccacctaacttgaataatctttgcttctactctacaagtccctttctcatcatcccccacatcaacaccaaatcttattgaataggtaaactctatgacgccactcactctctttcttaatacttaaattagattagatttcttgcaacaactaatcactacaaaagaacattgatgattgattgctttttcctttgttaaccaagcatttggttctctctgtaagccaatagaaaccaaacaaacctttgcttagttttttactcggtaaataattagtttgacaagtaacaagtttatatattatatagtgttcagtgttttaacttattcaagaatattctctctatatcatcaaatcaaatatgttcaacggaatcttcatcgtgttctcttctcatatccgagaaaaagtccttaagaaaaactcgagaaagtgatacatgaatggtattattgaaaatgttattcatataataagatgttacgtctgaccatgagctgcactacccaacgggaatattcggatttaattggcttggtagtcgctaccaacagcccaataatatatatactaacactaagaagagaacaaaacttcaactttaatatcccaataaaatgtgccgacaacaaaaacatatatattttctaatgaaatttctgagaaaacaaattatgaatgatagtcacgagtcttattcgtcggtgaaaccatagtttaaaaaactatcctaacatttgatattgatttctcttaaaattcttgtactagtttctacaaattgtgaaattgcattaacttttataacagtaaatcattgttaaatgattgagacatgtgagtgaatctatagtttccttgtttggttgtacaaaatccagtgcttttctctaccgttttgttatgtaaaaggaaattattcaattttccttaacattctttaggaaaaatatatactctttatgaacatataccttgcttgtctgtcaaaaatctgatatctataaaattaaaggcaaaaaaggatagtattatttttatttattttccaaaaacattcctggggaaatattgtctagggtaattattgcttattatgcttgccagtacgaaaatcacaaaaaataaaacatttttccactggcaaacaaacatttattagcaaacatttttccaatgccattactacattacaagcaaataggtgtgcagcgcacgtgacaagttgagttctcatcgtttaatctcaaccgtccaattaccaaaaagcgaatcatccagctgtttccctcgacctacacagctggcaccgccttaatgggccaagaccttaaaactcacctaaatcttgtagtaattaaccttttcgttaattacagtcttagggatttgtttcttcaacactttcccttaacgactaagccttaatgacgtctcacgcgtttttttaatacgcgcgtgattcgtattctcctaatttaggaaaacaaaatcatcaaaagttaaaggcaatgacaatgagcaaaaatgactctttcataaccaatctttcttcttcttcttcttcttcttcttcctctttccttatctctccatctctgtggagagacacaaaacttccaaaaaggaacattctttcagttctttacttaatctttcacaatgctaaatcattagccgttgataaagtcttaatctttgattcattcaaacgcgtttttgtttagta

SEQ ID NO: 4609 - DNA, 1047 bp, Arabidopsis thaliana
attttagcagtggttgtttggctctctttctctcataaaacagtagtgttgtgcaaatcctacataaagaaaaaagaaaaggaaattaaactcattgggttggtttgtattttacctaaacccacgaagttcctttttctttttgtaactcaatttaaatttggagtatattttactttttgttaccttcaaggcttcaatattacgacttcattgttcggtaataaatacctcataagctacaaaagattatgtaacgatttaacacaattatttttttaacaaacaaaaacaacgatctaaacagttcatattaactgatttgataacttatttcacaaaaaaagtatatgcgaaatacttacaaaatatctttacatttgattgtacatataaaaccaaaacaagttttaagatgaatgtggctagatacaaaaattaacggtgaaataagagcattctcgatttatatgttttgtttttatctattttagttaattctttaatcaagttgtttcacatttgtttaacctgattttcccgtttccaatggataaactcggattatgaaagtaacttgatgtacatgtttggtaagcttattggtcaaagtatgacaagccttttcccctaagtatgataagttttgggaaattttcagaaagcacactcttttaagttttagtttttagatgtatataacataactaataacatgtatcaaaagaagtttggaagagtttcttaattatttgttaaggttcttcctatatatatatattctgaaaaattcataaatcttccctaattaaataaaaaagatccattagataaaaccaaaatgaaataatatgtagatttaaaccggaaggtactaaaccggaaattggaagaggcaacgtgggccttatcttcttcttcttcttcctgctagattttattcttttatctcttgagcacacacacacatacaagactctcctcacagaacgatttagatttaatcgggaaaaagttcagtcagtgacactaatgttcgaatcgaac

SEQ ID NO: 4610 - DNA, 2000 bp, Arabidopsis thaliana
atttaaatggattcgttattatggacaccaaaacattgtttgttgatttttctttcagtttgaagagacctccacttccaagaccttatggacatggaactttggtttctttacaaaccacggttaatcgaatctcctgttatatggacatggtatatagaatgaatatgaatcagtaaaaggttttctgaatggatatatttaaatggactcgttattatggacaccaaaaaattgtttgttgatttttcttacaatttgcagagaccccacctccaataccttatggacatagaacttttaccaaattcctgagataatcgagatcaaattgtttaagaaacttctccaaaagttatggagacgtggagagagagagagagaggcgctacaaatcatggagagagagagagagagattttatttattttgggtaaggatcgtggaagaggaataacaaaaaagagaaattaagaattaaaaacataaatattgaattgagggtaaaaaagtctttaaaaaaaaagaattaatagaaaaagtgtctatttcctataaactgcctcaaacggaaaaacattctctaaaagtgcttaatagtggaacattaatcgcatgacaatataataagacgtaaaatttttggtcttatcatatgcaaatacttattaataaggaaattttggtcttataatattgcaaaaactgatttttctttgtttactattcatccctatcacaattcacaacattaacaaaaactttctaatggatttttcttcaactctagaacattgcaattccttttcaactctagaatatcaaataccgtttaaaagacaaaactatcagttaatgatgtcacaaattactcaaaaaattaacactctcttaataagaagaagacttgtattttaataataagaagacctcgtgtgaaacgagatcaattacaactttatgtattagactttttgacaaattcacaacggtcatcaaatggaaacaaacaaaacgaaggctcctcttcaggctctcaacggtcacttgcttagaagctgcgactacgacaagcaaaaatactcatccaatgaaaacgacgacgtatagaacctaacggtcgttttaaattctttaagattctatttttcatttaatttaaaaaggagaagaaaaaaaaagtgagtcatcaatgaaacacttctttaacacagatacgttacccacatgcccaattattagcattcgtttccttttagacgtgtttttgacttcatttgaaatgtctgttttaacctcacagagcaaacccaataaatcgcttacttcatcgttttagctattttagactgtgaatgaccgttttaccctccaacattctcttttgtactatctgctgtgttttattgaattttattctacgttacaaagggcctttcttcttatttgcaatactcctctttttgtttatgatagttctagtctactagacataatttgtttttattattaaattgacataaagttaccaaaaattgaatgattcttattttggttatgaaaaaatattggaataaaaaatctcatggatatatacatttttcattattaagaaaaaatgatattttcctttattttgccaacaaaaaaaaactggtcaacaagagtaggattcaagctaattttgttttcctcaaaataatatccattttgtagaaagtaaaaggacaacataaataaaggaaatgaaagttgtaagggcataaatgttatttacaaagtcaaagagactgaaaaactttgaataaagctcgataaacacggactctaattcattcaatattcattaccttcttctttcctttatatttaaaaaccttcttcttctctctctgtacatcgtcacaacaaaaaaaaaacagaaggagaagaaacaaaaacaataatctcagcaaaaacaaatctctactcatcgaaatcgaaatcaaaatatagaaacg

SEQ ID NO: 4611 - DNA, 760 bp, Arabidopsis thaliana
agtgtcgtaatttgaatctccttagggtttttcaaaataattgacaactttgacgtgatgaagagtcgcgctggtagattagggtttagattcttcacaatggtatttaaatgagaaaattagaaacaaatcttactctggattattatctaaattactggattataaattaccactaattcattttttgcgatttttaaaacggtatacattttattggcgcgttcaaaatttgaaacttaaactcattatattttcatattatgcttaatattagtcgaattttctttttttgacatccaatattagtctaagcagattgtggagtaataataaatcatcaaattttgttataatgtagcaatgtatcatctactcaatttttatgtattataacttttgtatcaaagaatacaattttagattcatcaagctttctcgaagtatatattcgacatggataatttctaagtacttgtttatcagattctcagataaaatatgaaaaagcccaaagataataacctgttaaagcccaagcaacaaatggcgcaaaactgcgagacgcaagaacggggacgtttaggttaaaacataaaaaggcgtcataaaactgttttctctttaaggcggcgcgtcagtcaatccacgtggacatttctttccacatttttgtcactttgtccttttgtgggattacgtcacttctataaaacaatagttttgtcctttatctaaattattctcccccaaccaaaat

SEQ ID NO: 4612 - DNA, 2000 bp, Arabidopsis thaliana
tttataaattaataaattctttcggtcccgagttaggaccagtgtaaaatgtgacacaaatcgataaattaataaaataataatttttttgaaagtcctatgtaaatatatggtctcatcaatatcataaattaataattgtataaatatatatataattgtatatatatatatatatatatatatattatagaaaaaaattctttataatatttttttgcttaaattcatatttgttctttgtttgactatagttttcatattttactgtatcaaaatttttggtgttattttctaaacattattattatgttttacttgtaactgattttagaaagatattttctacaaagaaagaaatcttatagaaattttttaaaaatttaccaaattaggaaaatctctttatatatttattattaatttatcgataaattaatacctctctaaattaataaaattttgcagtcccaacattattaatttatagaggttttatttagttagtgtcataatatcaaatgctaaaaatatatatagcatcttgagaagaaaaccatcttatttcttaattagaaaagaccatttctaaattattattttagtttagtctctatttagtttttgttatcacagacttgagaattaaaattcataaaaagatgtgtagatggtctggtcgaagacatggtttataataatcgattgcttccaccgagagataaacacaacaagtcatcgataagcaaagcacatattcacacttttttttaattcatatacattcaagttcattataggcttacacatcatttcaaaagattttgtcaattcatcttttttcctcttgccgatgtgccaccttcttcgcttggcgcttcgacgtgtgcggtgagcgtattttcttacacatattatattacactaaaatgtcaataatcgcgaatgtttgcggcagttgagatgaacaaattagattagttttaatttataattcacaaactatatttataaattataatgagagtacaataaaaataattgaaattatcgtaactaaatataaacggtttttacatataagtaaagttggtttacggcagtttataattcacacaaaaaataaagcgaactaaattgctaactaatttgtccattctaacaatatcaccagtcaaacttaatatttgataggttttgacaatctaataaaaaccgtgaataaaaaagagtaatctaaatttattttatattaagactgcaagttttgtggattaagtcagcatattttttctatatttttataacgatttatgaagaaaattgaaaataacatttttgaaaaatcaatgataaacattttatatcagttttactatgtaatgaaggtttagtttttttaaaaaaacatctgtatcagttctttttcaaaggcgaaatttaaaaacaaaaaatatttgggaaaactaaatttaaaggatatctacaaaacaaaattgtccatctatttatttttcttgtaaattagtcaaatgtaggtttttcaaaaaaaaattaagtcttatttacccttattttattttataattaaaaaaaattataattttctaatttatttatacaaaaaaaatagtaattttaagtaaaattttaagaatctaaatcctctaaatgtataagagtttttcaaaaccctattttttgtctctctttcttctttactcggtttaaaaaaaaaacattcagctctataaaaaaaattcataacgaaatagtcataacgaaattttttcatatgccaccagatagtcaaataccattgaccgacgtgctagaagaaaaaaaataaaaaaatttgaccgacatgtcatttataatctttgtatttaattattattatataattttaagatatttctctaaaataaatatatcaatcgtcttctcctaaacccagcaaattcgtttaccagtcatcaccaccacaacctccggcgaaa

SEQ ID NO: 4613 - DNA, 1565 bp, Arabidopsis thaliana
gtgggaaaagaataaacacagtgaaacagccttgaaacgctagtttctgcgttcttgatagcaaaatgcttgtttttgtttagattatatttttcctcgatagataaacgcaaacgctgtattctttatatgaattgaaaacttcaaatttcctattgaccgatccgtcaacccaaaagaatgtcaatgtaagaggctacgaagaacgtgtttttccgttttcgttttctgcgattgcgtttcaaagagaatgcatgcgtaaatcggtgcccgttacaacactttcgaaagttttggtttggactttaacgggccgatacgggccgtattataaaaaatttgtaaaataagcaacagtttaatggaccgaacttcgtcgatcgagatctaacgggcgagtaagaaccgggtcggaaatacggatccggattctgagcattaaattgtgaaacaactaactcgacaaaccttttaattgcagcaatttaagaggccaccgaactctcgcgcctcgacatctcaattatacatgtagtgaacagccaataatatttagccacgtgttcatagtttgttggtagttataaacttagactaataaactcgaccacttctaaccaccaccggttcatggacgaccgacctgacctacgaaagttaaagtgagttctttaataaatgtgagaccaaacgaagaatttttgttagcatcaaattaagtccaaaacatgacttttattgatttcatatgattcaattataaagcagatcagataagtgatgtgtaacgaggatgaagacattaattgttatggcgagttcggtataataattcgaattttatcaacaacgtccaaccagatttatccataatggctttaacttcaagtttgaaccatgatgatgtgaattataagaagaagaaaaaatcacaacctcgcatagtcatatattccaaaaatagagaaagtgaaaaggacatcttaattatacatcatgtattttttctttttatccatagctaattgacgtgctttaaaaccgtgagagtgttatatgccagtcataaattcccagcaaataaatcggccatgcaagaaaatttgaaatcaagaatcaagggcagtgaattcagtaacgtgtcaattctgacagtaattttttctctctttttttcaaaaaaaaaaaagaaaataatcgcatacaaaacaaattatatggctattttctgttaaattttataaatgatagtaattttagtcaaccataatttaaaatgtgattttgttttaagaatttttccctaagatggcatttcagtcaacattcatatatggtattatatataatgaaaataaataactttcttaatttcacgaaatggaaaagtttagtatagaaacaaatctttagtctcttaatttactggtggcagcaataaaagggatattaatatctctatctacttctctcaactgtaactgcccatatatgtaccactccctcgagagtatcacacaacataaacccaatctctcactcagactaagacagagtcagaaaca

SEQ ID NO: 4614 - DNA, 317 bp, Arabidopsis thaliana
ggcggccaatgagaagaacagaggacggagaggatagagatctcagtagttggagacacttaatatatagtgaaacagaagaaaccctaatcggcgaatacattagttgaactagtgtattaaagtactatttgttcatatgggccttctgggccacttatcttgataagtaggcttaaaaagcccaattatgtgctggtaacacccgacttgtaggctaaaaccctcggaacttgtttcacatcgagacaactctttagacttttctcagtaacaaaaacaccgaaccctagattttctttcacctgaatctgaag

SEQ ID NO: 4615 - DNA, 2000 bp, Arabidopsis thaliana
cttacgatttaagagatttgtgggaagatgatgtttttttgttggaattattgttatcgtttaatttgttttacttacgacttacgagattggtaaaaagatgaaagttaaattaaacaaaaatggaatttatgagagagaactcgatgggggagacaagtgagtcccacacgtacaaagaggcataagatgactggtccttgtgtggtcgtggagattcacgtcaatcagctaatagcttaaccaggccttcaagctaacgccgacgaatcgtctgccttgagaaccattatttaacatcttgttgataatcactatattatttgtcctaattacgtatatcattagttaattaccttgtcaaattacacgtcttttcaactttccgacattttcttatatgtcatatttttaaaatgttagtcggtctagatttgatgtacttgaatttttgtattgaacaataaagattaaaaaaggatttacaatataggttaatcgcatcatgttttaagtgttaactgttgttaagctattcataataaaacaaaggtgacattaaaacgcactacaaacgtaagaatttataaaggtataaaatgaaaaaacagaggcgtgggatgacttttccaataaagtaaagacaagctaataggaaagtggttcgatgagtttacttcttcgggaaagtggtgttaaattatagactgcaaatttgttagatggaaatgaatgagattgaacttaactaagtggcaatattgttctgatttgttactatcaaataattattcctacaatttatttcatagttttcctgtttttttttattaggtgaatgttattaatgtgatttattgttatcaaatacaatcaaataatgtaagactattcttttgactgttatataaaattaaacgcactattttgtcaaatgtacttattttttatattcattctattatgtctctgatgctaattttaaccatgctcaaattccaaaatgtattgacgaggttaaaatatgatgaactctaaataaacatttcaattttttaaaaaatttaatgttaaattatatatattttaaattatacatatcaatgcaaacttttttgaattttttaaaattaaaattctatcttcttatattgaattgccacctacataattctagcctccatcacttttgattgtgctcaagcgattatgaacatttttgtatttcatttttgctttcttattttcctttcatcttaacatttcaaattattctactttttcaagaaatcatataaattagtttagctgttgcagttttcttcggtttcggaaacagtttccactttttttttaaaaaatgcaaactttactttatctctgagtcaaatataaacttttcttttttctccactttaattatttcttggagataaaaaaaatagcaaaataacaaagttacacaaaaataaaagtaacgtcgtagaggagaaacggcaacaaaaaagaagtaaccgttgtaaaatattattggctgattccttacgtttgacctctctctccctttatttgttacatacctgatacctcccttaatcgctcttacactctcgtgatttagacgcgcgactaagcaatttccacggttaaaaaagtaaataattatcggagttagttactttcaaacaatttttatcctttgaaaaaaaccatttcgatttatagaaaaagatcctctaatttctctatttatttattgtaacctcataaatattcttgaagctacgtaaaagcgaacactgtgtcaacgacgctttgaccggggaataagacaaaagtacaagggtaaactcgtcttttcagcttcgcatacgtatgtacgcagaagagagaaacaactcaaccactttgtatatttataagccaaagagaataaaaagatagacacagagagataagagagagtctgtgtaatcctctcaaagacaaagaagaagatt

SEQ ID NO: 4616 - DNA, 2000 bp, Arabidopsis thaliana
tagagtcaagtttatacaaatatatgggacccaactaataagaaaaaaaaattattgacgtcagatatatactaataaagtatataacaaaggaccctcagtgcatgtaattaatatatattttccaataaatatcaaactatagattttctaatgtatttaatgttattatttctaactagtaattaattgataatttgacaaataaatttttgtttcacattattcttatataaaactgtaaatgatttgtagcaaaaatacaaaactgtgtatataatatactttataaatagtttctatgtattggatccaagtaggatttcgaagactttgaagggcacatctttttcaaagtttacttatacatatttaatgtaagataaagtcattgtttatatgtttttttctagaacacttaaatttccacaatatgataatttaaattaattgaattttgttttactttggttggtttgtggataaaatccaaatattacagtcactatctttcgacgtgtctcacttgcaacctaatccttttctggaatgtagctttttttttgtttgtcaattttatttctttctctcttaatccataaaaattttaggcatttttgtattactgtcaaagaactgattagctatgtcttctatatatctaaaataaaccataagaatcatagttcatactcattatggtattcttaattttctgaaactatcgataaaatgttaaaacgttatatacaaaaaaggactatcaacgtagcaataaaatgaatttagacttatatgaaagctaatggtgacgaagaagttgacggtgatgccggtcatttgggtcggtggtggttccgtcacggagactttgacggtgcattattgacgtcaacatgaagtagctctcacaaaacacaaaaaggaccgtttagtttgctagttattaaaaatataatgggcttcaagcccataataacatgtctttttacaaaacagaagccacgtattatataaacccattttttaatatataaataattgggctgtacttgggcttggacggtttcactcttttatttttatttttttaaagttttttctatattagtaatgatatatttacagtggaagcctttttggcggaaagttctattaatacttatacacaaagaaattgaggttcaagtcccaaatactgtgatttattagcagataatggagataagtgtgcaagagatctcgaacgatgtacaattataactgtttgccaggatttgaagatctttcaaggtgtccatcaaaagcatgaagacggagaagaaagtgtcgtctttcgtggatctaataaagatcgaaacaaattacccataatagaatcggctatataacggttctcataaatcataatttgcaataaataataaatctaaaacggtaaaagaaaaatatatttacatgaaaataacatgtcattttaaatatttccagaattaaaatataattccaactgtcaacggtccatatacgttatctatagactatatagtacataaattattttaaaaagacaaataatttgtttcgagaaataatgttgctgtctcgtcaaaattggaaaaaaaatacattttaaaatacagagaaacgaattattgagaggagaaatttagagaccattcaggttttgattgaagaaaaaaaagattcccattttatcatctttttagtttttagtgtcaactctccaacaaaagcaaaaaccttaaagaattttgttctttttttaaagcaaaagaaccaaacatggtttcacatgaatcccaatttcattgcaaagcataactaaaaataaagaagaagactttttggagatcgaatctgttcatgttgatgggttttggctgagctttctagagatagagctagagagtactgggtctgtgtaaagttgataactttttttggtttagagagagaaaggacagagctttacagag

SEQ ID NO: 4617 - DNA, 481 bp, Arabidopsis thaliana
gaaggtaacaaagatttaaaccttgtgctgaacggaaggatgttgggatccgaatcagaagatcatctaattaatctcttagtggggaaaagaatgtaaactagctttctgtatatacttgatagttttgtaacagtcttttgtatacaaatttgtccactgtttgttcatattcatttctttttgagctcttaggacagatttgttaccatatatagatcatataacattgactattattattttgatccaacaacactgtttccttctccttgtaggtgaaggaatggaaaatatactaaataataaaaccctattgatatgatgaattcataaccgtccgatcaaaacccaaaaagatctaactataaaaaggaaatcgagattcggtgagccattcattgtttttgattcacacgaagagaagagaagaagaagaagaagaagcagaagaagagaagaagagaagaagaatccaatc

SEQ ID NO: 4618 - DNA, 1246 bp, Arabidopsis thaliana
cgagtgacagtgactgcgtcaaccatataagaaccaaaaaatgacttatgatatatgaagcctttcgatattgattaaaccaagaccactaagtaaacttctaagttaagtccacttctgaaatctttcacacagctgtaacaaagctactttaatggatcaccaaattttagacaaaccttccttttttcctaagaatgccagtgtgcactcaatcatgtaaaagaattttccgagtagaaaataaaagttatggagatagaaagaaccttgtagatattaacatattctcggtatctttgcacatgctgaggcctcacagaaaatccatatgcatccctgttcataaaaccaacctcattaacttccctaagtactaagaatatagatgaaatcaagatcaatgatcactagattctcaactagtgatctaaaaagacaacattttgctcagcaaatcgagagcagagagattaactgagaaaccgcaatttcaaaaaacaaattccatcaaatgtagtaaattagaaacaaaaacacaacgagataagcaatgtagcaatggagaagctcgaaaggcgataccttttgtggtcagacttagaaacggcgtcggcgatcataattccttagttggagaacgagatctctccgaatagaggcggtgatagttgaaagagatggctgagcgcagaagaagaagatccggtggagcaagaagcaatactactaattgaacatcattacaacacgcgactgaagttgaaaaaaaagatgaaaagttactacagtgtcggagagagagacgaagaaaaaggtccgagattgtagaggacgttattgcatcctttaattaatttatatacttatcatcaaatactcgaaacctttgtccttcttttgaaataaacttatactggaaattaataattttgggcctaaatcaactagagcccatttgtttcatgtttgattaaaagggatttatataccctattgagtccacgtcacaccgtcgtcgttaatcgtggattaatttgttttgggcctaactgaactataaatccacttgtttagtttttacggtaaagtcacttttgccctttagaatccaccaaagtcgccactgtctttcccaatttctttgaacttttcaggtacccttaaacttcatcttcttcgatttttaccatttttttcaatttgcaatcagaaatcgaagcgatccaaattagtaagctcgccc

SEQ ID NO: 4619 - DNA, 2000 bp, Arabidopsis thaliana
ggaaatttgggtgtataaccataaaaaatttaataatttaacaagtaaccattcaaaaagttggatatgatattcagcatatattgtgtagtatatacacatttgcccttgtttatacacgtgcttctctcctctctccaacatgatgcatatatcatcatctctttcttctccaacagtttttttttaaagcaaaattcttttgtaactcttttcacaacagtcattttctctctttgtcatcgccaaaacaaattcatctacgacaatggagatatagcaaaggaggatctcacatcagcctcacacaaaaagttttcaatttcgatgacgatgagtaaatatttacaaaagtgaattttaaaaacatggattagctaattagtttttaaaattgcttataataaataggactataaatctcacaggaaattctagtgagattaagtcaaacaaatcattttttattttaggaaaagtttgcaagatattattctattttgtaaattaaaaataattttttattcatttatttattttaaccaatctgttacctaataaaaacatatttaattataaaatttaatatacaattaaaatgaaaggatatatctatttgggtttacaaaaagaatattagggttttggattttatgattaaacaatgttaaatattggtttgagtttataaacaagtttaaattttacaactaaacgaagtcaaatgtcggtttgggtttagaaagtacaattagggtttagattttataattaaacgagtaaaaatgttggtttgggtttataaacgagaattagggtttagattttgtaattaaacaagattatatatcggtttggatttatacaagaatggttaaagttttgattttataattaaataattttaattatttattagttgaaatattttgattggctagaataaagaatggtgaatatgagaacccaaatattgttctttgtgaatatactgtttacgtttatgttatactaggtgcgtttaaactgaattgtttgttttgattgatattcattgtcatgatagagtgttttcattggccaaaccacagtgtttgaaattgaaatactatttgatattgcatctctactttcttgtctatactatttcagtttttagaacaccaattttttttacttacaaccatttttctattttgtaaatattggttcattttaaaaaattcaaaccactacataatcagaaaaaaatctaatgttttttttaatatagctagaagtctaaatcagtttattttagagagatttttagaaagaaaatgtaatggggtgtgcaaaataatattatccaaaaacataaaattaatcttttctcttgtatgttcaccacgtcagctcgtccaaagccttgcaaatgaggagtttgtcgacatttcatgtcatctacatgttacttacttagttttagattttatagtgctatatccttaaataatttatgaaaagtagttacttttgcaattcaccctatattataagatgaaataaaattattttgaatacgaatgaacaaaaaacttgagtttttaaacttccaaaactaaaaatgttcggtttattatggttctttattttaaaaaatataaattttaaaataaatttaaaatattataaatatttaatttttattatacggatgaaatcttacaatggactaatttaaatcgattataataataaacgacaaaaaaaaaaaaaatcgattataataataaacggtataatacatgtgaattcctagaattaaagaatattttgcccatctcctgcaagttataagttaattacaatatgatgaaagaagaagataagagagatccaaagagataagaataacattaaagttactctctcggtgtgggtatgacgacgaattgacttaaaattttcgttagtcatcttttgtcaatttcgtttcaatcatttttgacacaaaaagt

SEQ ID NO: 4620 - DNA, 2000 bp, Arabidopsis thaliana
atcagagcgttgagtatatttccaaccaaattaaaaacagaacaaacacgtttcttaatttgaaaatctgaggctaattttatcaaacatgcatggcaggtatagagaaagtatacacacaaatactgaaatgctcaaatgcatgtatacgaaccaaaaaaatcatttttttttttgtaatatcatacacactatgatcactaatactcatgagccatttagcaaccaaaaaacttacatgaaaaaagttagaatctcgtgatcgtatttttctacccatgcaagcgacaaaacattattcaaacgtgtgaagtgtaatattcgtaaatgctttaaaatttaccaaccaagatccaaaaatatgtctaattctgaaaaaaaaaattagaccaatcaagaatatttttgatcatcttgtttaataccgcacaccgtctaaaaacgaacacattttgcatgtaaaggtgagaggtcaaaaatatgtttgtcgaatatccccaaattagaaacatctagatatttgttaacatataacttctttaacgattgaacagaactataccatctcactaatcgatgtatctgaatattctttttaattttttccccagcaaaactccaagattggttattttttttccacacacatcacattccaacggtccataatcaaccaagcaaaaaatatcagaggatttgtttgttggcccatccatcatccatctctccatgtgggtaacaacaatgtaagcgaaattattataaagttttcatcaatagagttagaaaaggaaaaaaatgtggagaaagatcaaaaactaaaacacataacaaccttataagaagatcactataatcatacaaagattgcaatgttatcaacaatacattgttttcttaacctatgattaaagttagtcagactaatgagaagtggatgaggagctgacgtggaagtgagtgacgtcatctgacagtgaagaacacgtgacactcgccagcaagaaaacagtaatgggaatccaattccaactaatctttttccttgcggctaattttgtcttttaccgttaccatttcaacgtcttttcaccgtctctcctccacgcgcgtaccattcaaccttttatcttaaccagcggtttagacccggttaacaccgattaaactgagacatcgtccggtataactaacatccaattattctcgttatcgtccttaaaattgacaactattattgaaacaagtctttggtcggattagaatcttgacgcaacttgtcctcaaacataatatagggatacagttgtacacatccattaagttaaatcattgattaattaagtagactttatcattaattatgactttttagtactgatctcaagcaaatagaagcatcagtcaaatttttgtttctaaataaacaaatctataaacacagtttcagtaatgaagaacttaaactctgtcttaaacccaaataatttctgaatttctccagttctttcttcttaatttgcaggttttggtcccaccgcttaaattaggaaaaagtttcctttttcgttctgggttttcttctctgattattatgattcattcctcgagtgtcgagctttattctcaagtgtcaaattattgagggtaaaatttacttcaacgacgaaagttcattgaaccttagctcttacgttgcgtcttaaatctcattctcacccacaaaaaaagaaaagtttgcattttttttatctctcaggattgggtttttgggaatttaaaggaaaagactttacccttttattcgttttaatttcaccaacccattaaagctcgttgatgacgattcctctgcttttccagtaagttttttgtaatctttcctcttctcaagattgctacttgtttaattcctcccttatggatcttgtcgctttcagattcgtggacatcgttttgttcgattgatgtttcgttttactctactctgacttggaaca

SEQ ID NO: 4621 - DNA, 2000 bp, Arabidopsis thaliana
aatggtttacacaagcattcatcttaatactcaatcacgtataataactaacatactcagtccttgtttaaacacttgttatcttataaccctattactttgttacttcgcgagcatgctatctaatttttacatataagtgatataaacatacaataactatatgtctatatccatgaaccttactttataagacaatcatgaaccataaccatgcatggaaaatatgcggatgtgttaagaaatttttatcgacattagctattcgagttaatttattaagtggtttgtatttgaaactatatatgtacactgtacacagaagaaaaaataattttaggataccacatatggttgatcaaggaacaaaaaaaaagaaaagatggagtagaataagccaatagttttgaaaagtggagcaggaagaagcgtaatggaaatgataaagttttgttatagtagacattatccatttctgcatacatcatccattatctcactttaactgctcctatgatttttcacaagaaaaaataataagaaattaattaagatgtaaacaaaactgaaaaccaaaaaccatccgttgaggaaatatccttgtacacactataaaccccacagtaatatgatataaaaatattttccttaacaataaaatgaaatatttgggtataggtcaatgaccaaactgtggatcaactaaagtaaatatatttctattattggaatggaagttcacacttaactcagagtcctttctggatatatcaaatccgatcagagaatttttcctgaatgatctgtcattcagtcaaattaactaacccttaagacccaaaaatgcaatagacctttgttagaggtggaggtaaccctggccgaagacgtaaccatggcctaataggtttatgtcataataaaaataaattaaaaacattatctatcaatttattccaacataactaaatgttttttctactcctacatttttcgtaatatacatttattggcatttcgtaaagctaaaaacttataaattttatcaaacaacatctttgattacaattgattaatttctcgtaatctctctttctcttgtaactggatcttcagagccaaaactaagttaaaatcttaatttagccattaagtgaaatatgtagtgataaaaaagcttccccttaaaaaatcgtctccaacttgtttgactaatataacaaatccactacacttattagttaatgatttgataactccaaactagtccgtaatttttaaatcgcttacgctaacaatattgtatcttcaaatttactaagatatattttgtttttccgagtcaaatgtgataccacatgtacatatatctttacaatggagtcaaaagagaagacatcatgacgcaaaaccccaaattttgagtagagtggttagggcagttgatgaaagaacgtccctactctttcctcttcatcctttatttatcagcttatccttaatcgaaagctagaaaacaaaaccgctatttcacattttctaatcgttattcaaataataagtttgtgtgagtctaaaagttagatagcaaaagttgcaaaactattgaatttatttttccatgtttttttcggaaatactgtaatgtgatgagtataattggatctgttagtttgttggttttaattagaggttactactatagaacattttatagttttaatgtttctataaccaaccaaaaatccattagatcaaagtatccgaattcaaatatcgtgtcaaaaaaaacacgatcatgcaatatacatttaagtgtcataaattaaccgttacgtattacattgtgacctatatgatagttacatttatttattatacttatataagcatagtccgtccctatctcatatgtataaataagacccaacccatccatcattgttttgcctcctaaaatcttacaacacaaaaaaaaaaaaaacatttagttaaatcca

SEQ ID NO: 4622 - DNA, 2000 bp, Arabidopsis thaliana
gtgaaaaatcatatgctatgcatcgacgaaatattgctaaatgatggggcattgtgaactatatgtatgtattttccttatttcgctgttggacttgatagtttcaagcactatgtcaaactttgatgttttgagtttgaaataataaaagagagaaaaagagtgagttagataagtcaaaagcttacattctaatatctccatgaccccattagtgatttgatcgcaaaagttaattattgaaaacttggtgaaattttgctatcgaagataaatcatgcggtatcttcctttctggtttgcaaaagctagatatgcgtcatataacattgttattcacttattctgaaaatttctaaaatatattataatcaaataatgtaagctagtaagtcaatatattcattctctatgaacttaaatactgttgtatacttgtatatagaagattagtacagttgaaacatttgtagagaaagggaatatatttggtataacaattcattgaactagcaaagctgacaaaagagaaatatacaagtttaattaacccttaataatgctaataaataaataaccctcaataatacgtatttgtttatatagataaattagagaggtaacaatacaattggtgaggagccattgactcgagaaaagagtcgatagagatgtttgaagagtgactatttgcaagagacaatagaatagacgatgcaaaacaatcgactcattagccgcaagtagaacaagattagctaattggtacaaaatcgacgaaacaagtctatcaatacaaagcgagtacaataaaaacccaaataatatatttttctcaaataaaattatatgatcttttgttatttttgttttttttcttttgtttaaaaaacataaaaaaatagagtattttacatcatttatttaatacgtaaaaatattggatatgtatgaaccctctcataaagcatacattattttattttaaattaagtaaaaactcactaatgcacacaatgacaaaaactcatctaattgtttgaatggtgacctaaatacggttgatgaaggtccagaaagaacccgcaccggtatgaccagcacatgtagccgttcacagacatatttgaatgtcttgaatttcaaatacttaaaccacatatccagactttgatggtccattctatgttttaactggtagaattttccaccaactcgtcatgttacccaatcgtcctgtatttgtttgagaatgttgtgtaattattttcaaaattcaaattatccgttatccacccttaccaatattgttttgtccagatatcttaaatagacaatcctatcgaaaacttatagtcaattgcagactaatgttttggaaatattcaggatacatttttatttttgagaaatactctaaaatatcaaactattaagtttttgtttcaaaagtaccatcattagtttactttgcccataataccaaacttttttgtataaaaatatttgttcaaccaaaatgaattacaattaaaagagagtttttacttcattttaatctaaatactgtagactaacctttagaattcttcaggatatctacttcataaatctattagttttgtaatcattctcagactatacgtcggaaaaaagattcggaagatgttctacgtactaaccaatgaatattcctactctttagctagttcattaatttcccaaaacatttagcattgaaattgtatgtagattgaatagtttaaaagtttcaacagccggcaatacgtgtttgagacgcgtccctaccacattaaaaaactctattccacaaacttgttgagttttttggttgtttgtttaaccacaagtcagcttactattacgcctataaaagccactggcaaaagaagagttaaaaacgcatctaattagcccatctctctcaattgtcacaatatcacaacacaaaaaaaaaaaaaaaaaaaacacagcaaaaa

SEQ ID NO: 4623 - DNA, 880 bp, Arabidopsis thaliana
gatcgtagacaggagatgcatgcctgctttgtctcatcacaaagtggcaaagattgatgaatggagagagttttataggaccaataaatccatcactttcactcatccttcgtcccagtgtacgacccgtgaactcattatcacctagaataacacattttcttgtcacatttaaagaattaattacgttttgtacatgataaaccctaattagcaaataaaatcctttctttgtcggttgatctaactattaacacttgatgccaagtctaaagagtttattagtttttaaaacccagtttaccaataataagtttcctttgtcggttgatgcactagtcaaactatcaaagtcgtcaagtttgctttgttgacaaggcaaagctactcttccaaaacattgatccattcttctggaaatttgcaataacgtctcaagaccaatgcaagtaataatttaaccatgccatgttatcaacaaaagctgcttctctgatttctagagtattattttttaaccattattgaagtttgaagatttcttattattgctaaatggtaaaaccatcttgaggggaacaatttgataaaactgtgtgctgcttcctgtctccgaccaaaacatgtttaaaattagattcggaccaaacaagttgtcaatttttagtacaaatcaaaggttcaaatgtcaataaataatcattacattttaaaatttcgaaataaaaggacaaacatgtaaaaaccaaaaaagtgaagcactgatatttgtcatttctgcctataaaatgtacacttcccactcacacggtcacagaaaccaaattcgaagaagaaacagagaatcatcaaatcaaatccctaaaaattgatttttgaa

SEQ ID NO: 4624 - DNA, 2000 bp, Arabidopsis thaliana
tcatgttaataatgttttttcgaagactactgtttcgattttgagaaaaatggcatagaactgataaagaatgacgtactttcttattgattagcatgcattctctaattttcatttaacaaaaaaaaatgcattctccaattttctaaactatgcaaattgcttagaaaccggtttagttgtttttgggttctcttatttctcacgatttcaattttataatatatataacttttttatgggtgtatgtcctatatctttaggagtttattaggtaaatgacaattgaaaataatctacattggtaaagtgataatggaacttatttaattagaaatcaaatcctacatgttggcgggagagtggtctctgattaagctttagcctaacgattggtagatctctttaaaactacgaaatcttggtgaagattgtatgctataagtgtgtgtactgtgtactatttcgaacaaagtgagaatgtctaattgtagccaagccgccaagtagctgccttaaatgtttgaagacacattcatcatttaaaagggactttacaatgaaattgaatatgtatacctccttttttttttttttttcaacgtatacatacctcaaataaatggcattttcaaaggaaatcactcagtcgatgagatatgtttttgtggcgctacgtgaaaacataggtaaatgaactttgtgcatcattgttggaacgaaggatatggctatacaaaaaaatatttggtttccgcgatggatatgatatacaattcaaagttttgaagttgaatattacacatttttcttcaacatatatgttttcttttcagtaacttctgaaacctaaattgtgatatggaattatataaaacgagttgcaactttttaaagatatcaaagataatgtcaacgttattttttgtaacttttaaatgtatacatcacaaattcataatctcttttttttttttttgataaaccgtaggaattccaaacatttgttccgttgataatactaaggcgtataatcatctcttccaagtggggttgagctagtgatctacttcttgagcactcacgcagacacgcagtcactctcttgaccactaggccaaaaacccatcagataaattcatacataatcttatacactttatatgttttattattacaacatagaatataatcatacacacctaacagaaaaccttaaaagcttaaaacctttaaagagtaaacaaatggttgaagtagtagacccaaaatcattaatcataggtatgttacttcctatgtcaaaagaagaaatatgaaatcttcttcttttagttataggaataagccaaatatactaacagcaactagaatatcaaaagtgtgaccaaaaaaaaaaaaaatcaccaaaaacaatataattaaaatatctatttaatcctcgtgcttgctctctcttccagagaaaggggaaaaaaaaaaaaaacagattcctgatattttctgcttcgcttcgctttgctttggcctttgggtttgctttgccttttatctccacaataataatattcgttaacctctcctcgttctcgtcgctgtttcttcccgatctttgctatagttctggattcaaaatctttcttccccaataggtatacgcgaaaaaaaaaatccaacattttcttcttacttaaatcctcaaattttgtcacttgttcatgcttttaagtaatcaatttcttaatttcagtgttaagtttgtcacgaatcttatttcttttctgttgggttaatgaatagtcgattaaaaatcccagctttttcaatctgttattgctaagtgattaggaatctcagatgttgacgttcactgatagggttttagtcaaaattcctaatttcttcaagctttatagtaagaatcttaagttgtttgttttgggtacagatgtttgtctcttaatttttgatttttctgcaaaatcaaatttttaagagct

SEQ ID NO: 4625 - DNA, 1486 bp, Arabidopsis thaliana
cttttaaaacttcttgtaacccctgatctgaaactccttagctgaaactccttaacaaccctatacaagcctggagctctgataccacttgtggagaaaagagtgatagagattgcttggtaaagaaataaacagacacagaaaattgataaccgagttcacggcctcaaccgctacgtctcgggggagatgtcttgctcccaagcttcactatatcaaagggattacaaacacaccactaacttgtgatgttgtcttttggtttttacagatttacactcaagaagaacaaaaattcaaaaacaacaaagaggaagaagaaaggttgctttagaagctcttttatctctcttctctataactctctttagattcttttttcacctacctccactatacgtcgcacgttgtaatgcatttataggtgacgtaaatggggcacagacttttgcccacacttttgttcttcttcaccttgccaatttcgttggcctattaaggcccaataattgtattatgtcaaatccaaacaacaagtttgcttttgttagatcatcttgaaaaatgtgaggcttctatgtgttgcacaatattgtgaagtttttgaagaacatcattgacagaaaaaaaaagtaagaggatcatatccattataaatgaaattgtgtggatcatgcgagaaggaaattgattaatttgtataaacgatatgaacgggtcattacaattgtatataattaacaaaatttaagttgactgggactctaatattctataaatatttagggaattttagacattcctctttgtacgaatgaatgttgtatctaaaaaaattgtcctcgatcaaaagtatatatatgtagatagaatcatataaccggaccagtttttatgtttgaaaatcagtgtctttgggtgaaatctactgatttaaaaaattgctgcggtaaatttatcatgatagtcaaacaatttaacctaccacgacaaattacattttcacgaaagaacatgtaatcagttggagatgtgacatagaaagagtctatctaagccatgcgtcgtatattttacgagttaaacgagcatcaacttgaacctatcgttgttaaattggactttgttaatctccatactccaattttggaggaatgataggaaccctttatattaaaaaaaagagaccttttgcatttcttacagaagtcgtggatgaagcaaacatgtcttgtttatagtatttgaccattacttacacggtaaactaatgacgtggcaaacaaacaacgtcgttaaaaaaaaaggcgcattataaccgaaataactaaactacgccaagaggtaaaattaaacacaaggatctgacgtgggtgatgataacaaccacggacccgtatcccaaagatctcatctttcgtcgagtggttcataaccaaaatcaaaacttgagtgaatcataatcgtcgtctcgtcgccggagaaa

SEQ ID NO: 4626 - DNA, 1255 bp, Arabidopsis thaliana
aaccaaagcaaacgaaattgcaagtaaggaagagaaaagagagagatttgaatcttgttccttagtttgatcttttgatatatatttgcatacaccatgtccggtaattatctaatattagggcacaaaaaggtcattctaaagttaaaagcagtagttgatcaaagtaaattgtttatgtgattcatcttattataaatgtattaacgtaaatgtgtgtactattatgacttttcaacatgcccgcttcagttttgttagcatttcgttgttgtaaacttgcaatctatttgtttggtgcttttattagctttgtcagcttataaaaatggtaaatgtgaatcaagtagtatagtaatttgtgcaataaacgagacaacgattccccatgaataaacaacaattacttcctgacaaagaagcattgttctttggattggcatggataaaatagagagaggtaaaaatattacgatttggattgggctgaggcccaagatatggttacacgattttcaaattctcgaagttgtacaagtagacaaaagacatcttgttttgtcgtgttgtcgtttggtgtttgtcgttttgatgtgtttgtcaaagaaccctgttactaatctgaacgaatataacttgtcagtgtagccacattacactaatattcagagaaagttgtcatgttgttacaatcatgagtcacatagcatgtaatagagtgtacatttcaataggtttagaagtttagaacacataaatcaatcggtccatctaaaatgtttgcattatggtttactcattgtaacttgtaaacattacatatgtgaatgcttactatcctagaaaagcaaaactgttggaaacagctaaaaattaatatatctgcctaatattttcagaatatgttatttttcaaccatccgaaatagtgctatttaccaaaaacacacattaggattagtttaccaatgaaggaaacaaagcttcgttagtcacaaaccacatgccatcattttattctttaaagagctttcaagcttttgactcatagaaatagaatccaatattcatctcttttaaactgacattaaagcccttcgcctccttaaacccacatgctaaattcattgcctaaccacccaaaacatccaaagggtattttcgtcactccaaaaaatgtatgcatatcgaaaaatactttagcttatatacacacacgtcgcattggcacacctttcacaccaaaagctacaca

SEQ ID NO: 4627 - DNA, 1321 bp, Arabidopsis thaliana
agagactagagacacacttctattaacaattgctaccaaaatttatatttaaatgttaacatgcaagaagtagtactataactatttgatgtaaaatgcgaagagttaatttgagctctctgtttttatcgaattcagacttaaacctgtgtcttggattagaagatgaggaagtagtcatttgttctcctgtatatgtactttcaaaacttatatttacattatatgacaagaaatttataccttttctttattttcactccagtaagaaatgtgttggaattgttatttgtagttttgaagacaaaattcaccagtgagtgataaactgataatggaaaagaacaaagaaaccagtttttaactatttgcatatgtaatttatttgttgcaaattatatttagttaaaatgtttcctctatttatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcgtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 4628 - DNA, 1834 bp, Arabidopsis thaliana
tgccactgtcgaagaaactcgaaactatattagacgctgtcgttttgtcagcttatcatcttcacgaatctactattagaggcgttatttgcattaaggtccacaaattttcaaatataataacatcaccccacatttgtgagaaaaaaattacaaaaaaacaaacaaactctaaaagtgtatcgaaacaccctcatacttcttcacatttgtgtgagaaatcaaataacaaatacattcgaaaaatgtttgtgtatatgatttaatatttttttggtgtggttaaaaaacttaagacataattaagtaataacaatttacaattgtaacgtggatattttttgaaatgttgatttatgaccaaaatagtattagatgaattctccaagaagatcatggtatgataagaataagatggtatagtgctaaaacatacccaaaactgtaatcagtttttgaagtaaaggcaatatctttgatttgggtaatagtttgtttcgataattttggatgtacaaaattaatttttaaagtggttctaagctgctcatccaaattttttaaggatcctaatctctggtctaaacttcattaatgaatcataaaaaaatctacggaactaaaagaagaaattgattatatccttcaaattttatagacaaacaatcgtgcagattaaattgtaaatatgctaattttgttcctgtgtataatattttacattgtagcatcctttggtagtgtagatgttgagaaaactaatattaattggtaaattatatatttcgaaaaacaaaattcaggtaaatagatttggaggaaacatatgaagttaaaatgttatggataaaaacagaataaacaaattattgtagacgtaatccaaaatagtataaaataaataattttgcagtaacgtaagattgcattcgaccacacgcatctatatcactgcgtttttagctgcagctttcgatagtaggtcctacatcctattcggatctgacgtggatccttgatcacactctctactttagggactcaaacactctcacatttacgagaattgccactaccacgtccctcagtgggaagggtactttcgtaaaaccaaaaaaaccactttccggtttccgcaaaaacccgtcaccgccgctgcatcctcccttcattcttttctctctttcaacgcatatacatacacttatatacgttatcaatatattttatttttaataagtccagtttttgtctgtgcatcgagtttaacaggcaatgctcgtgtctctctctctttatatgtttagattctttatctggaacttggaagctcttttgttagctatatctaatcggtgatctcgaagcttattcaatccctctttcttttttcgtgagtttttatcttcatgttgattcggtttatattggtttatatgatgatgaaacgtttcttataattcttttgcatgtattgatctaaaaaaatctagctttcttctcttctgatctctgttttctttttgttctttcccttttttacccgggaaaaagttacggtttcatgtttaggattggcgttactattatctggtggcctatcatgattggttgattgttttgtgtgttatactggatttgagaaaatgggtatcacggcattggcacttgtggcatctaactaatatcactaaaaagtttgattcttttgaggaattgttttttgactggaaagtgttcctttttgttcctggatggtgacaacaaaggtagctttgctttccttattggcatatttcatgtgaatttagatttgcatatttgtgttgtagga

SEQ ID NO: 4629 - DNA, 1673 bp, Arabidopsis thaliana
tgtcaataatatatgcatgaccagtgttgtatccacttttgaatgttgagtaaattactattttacatggattgcccatgcattgagaagatgctatgttttatgagagctctatgatattggttcgtttttcggctagattcacacaaacaactcttctcttttccttctcgatcactcttatggctgctctcagagtctccgttttcagaggccaaaacaggtcgcaggttgatggctggcaatggcagcatcgactgcttccggtgtgtcgagatcaggcgccacaccaagcatcaagtcctgaaatcgaattaggtgtgtgtaagtttcttagcctagatacaaacaacaagaaatatgactccaactgtactcatcatttcaatcacttgatatttgcttcctgtaagggcttcaatgtcaaaagcttctgaattatcctaagtccatacatatttgagagactgagacggtctcagtgagaccaaacagaagaagaaaagaaaagaaaaaaacagaacaaatactacaaagaatacacaaacttttgattcttgctccaaccgtttattaaagcacatgacctgtttgggatcatcacatatcacactagaatcacaaaaactacaaatttcacagctccgagcacgcaatgattaacagaaatccgacaactacaccaatctcttacagattaaaacacaaagaagagagcttgtgtaagttaaacacgtatggtaaatacattagcagtaagaagataccttggcttctgaaaagtggagcaattgtggacttcacatagagggatggaggagactgttctgctccttacagaacaaaactagcgacgactctgcacataattatcggcataattaaacaaagtctggctctttcgaaccccaaagaagagtggcgatagcaaagatggatcctttgcctctgcaacttctttcgatggtttcctttcctctgcttcccgtttccctttactctgttgacaattagggtcaagttttgatccggcccgggtgatttacagcccacaaggtccaatgggcttcttcgaaaataagtttgcgcgacgttgcaaatgtcacgtgacttttgttcacgcgcacttcacgtgttcttcgttattcttcgaaaccgtccgataaagaaatttctggaataacacaacataaccaatgaaaagcatacaggtggaagtaacgtaaaaactcccgctttttcgacacgtgtcaactaggcggaagatacgcaccaccagaaacgcttgataaaaagctaacccgccccaaacccatttatcttagggtttcgcgagatctcactctcactggtatgtctgtgtttcttcttccattttctgtttctattggaaacttctctctccaatttcgttttcttcacttctttgatcctttagctttgacaaaaccgtagtaaaggatcaaaagttatcatctttggtccatgttgtgaatcgtgctctgcttgggtcgtgactcccaaatccggatttgaaaccagcatatctgagcttaattcgagcatgcatgcgcttctttttttctgattttttttagactttggttctaaatcccttaactttggattaactgtcaatctacaattttatattaacagagatagcttagcaa

SEQ ID NO: 4630 - DNA, 2000 bp, Arabidopsis thaliana
aaagcaaacttatgagtccgaatgtttttgatctgatttaaaataccaaaaactaaaaaagaaaagaaaacacacaatgactttaatatgtaaaatacaaacaaatgttgcaaaagaaattaagagagtttggtaatgccaaataggcaaaagaataatttatgtgtggcaagcaatgaacaaagctgagctgtacatgtaccacacctttcattcattggttaccatctaactgaaagtgacacgtgtcttataatcaacaaggcttttctgacgtggcagtgcatttaattatttgatttgacaagtttaggctatcgttgtcaaacaaattaacttaattgtatcaaaattgctcgcacagtacgtaattctattttaagtttaaaatcaacggagacactagtgtcctatttaattatctccaagtaaagaaaagaaaaaataaatatttgtgcttagttgattaaaaattaaaaagcacgattcttgtcttgagctccttacagcttacaagataattaagaaccaaatcactttttttggttaaaacaaatcataatgttagaggctagagatacttatgatgttaccatgcactttccccttaataactagctcacttaattacagtaataccatacagtaatatctacttgatgtgcctattgagtcatcgatccaatgaacttattcactgcttcaattttatgaaatatcattattttaacgtaaacatcattactagtgtttttatcatcaaattaccgatttagtgtaagtaaatcgaatcagtttttaaatactgttggacacatatatacatagacatgccaattactcaagtatcatgttggtttgcatatactctagttttaatcagggtttatattatttcaatttaagtaaacgcatgctaaatgatagatcatgaaatagaattagggtatccattgtttaatgaaatgaatcgttgaactggtataacatgcaaaaagataatgtatccactatgtaagcattataaggtgccgctataacaaaaatatccacatggtcaagactgaaacgtcgcattatcaaacaatattacatgctcaattgttaaattttctagccaaattaataatatcgtcatggaggaaaaaaaatagagttgaataattggcaatgatcataatggatatgggtttctcaaaaacgcaatcatatatcgtgcgacaaggttacagtaatatagatatcatgcttattccaaaacgacgactaaaacgtaaaagattacagaactagtaaacgagtatataatgttagggaatgttctttaatttataatctagctagtataaatcacatatcctatttcatatgcgagatatgaacaacaaagtagtatacttaattgaatcaataataatccaaattaaatttatatggtttagatcatagagaacctaaatatctaaaactaacaaagtctaaaccacctcgattaattgggaataggatgataatataaagtctagattttgttttagttcaaaaatcgaaacaaaatcttactgtaattaacttactacgttcccttactgaagattgatcaccacacggtaaaaaaaacaccgttaaaaggttaaaccaaaaatattgctaagaagacattatttggttagttgaatgaaaaattagggaatgggaagtgtgaaacctacctaaaatatggctatgtagatgatattcattgaagagagagagaatatagaagtgtaaaaagagaaaatggtgccagctatgaattagaaggatcaaagctttctctgaagctgtcatctatctctctctttccttatagtgctctgtttctctccacattcacacactctccctctctctctccattattaaatcacttgttgttgtctttcttttttcaaaccttggaagcaaggaattcttttttgatgatttaatcgaaagcttcttcctccaaacaaacatca

SEQ ID NO: 4631 - DNA, 2000 bp, Arabidopsis thaliana
ccctcatgggatgaccaatgagggcggtagttgaaaatttatcattaattcgtaaaattatgattgttttaatgcataaaggttcaatttatcttttaaagccatagaattctatatagttcagaagtaaatcagtgttaagtttttttatatttcgactcttagaaaaatataacttataaatgagattcttgtttataactgctaaacttcaaaagtaatgatataaaacatatgtttgcatcattttataaaaattctttcttatactttttcattaattatatacatatatgagtcacacatttctaaggtcgactgtctttggcatgtagtcctaaagttcacattagtagtttcattttaattataggttttgtaatttcggtttagatttccaaaccttttaatgaaaactctttctgttctattttactataagatttttaggtaaaagcacggtctttaaaaactggtaaaatatttgatcatttctacaattccacctaacattttggttcaaatttcttagagatagacaaaacaaattatcattaaaatgaaaaaaaaaaacaaatatgaagaattttacataaaagagtcttagttctaaatataaagtaaaaaatatagagagatttttaagttaaacagaagttaaatataaaaaaatggatgtaagaaaaaaacagaagacaagttattgatagagaagaaatatatctaggcacattgcgttgcattactaggaaagaggatattgcgttgctcgtctctagacacatatctcgccttcacaattgcactcactgttgttagattctcgataacgtgggaataaatgtaggtgcttaattggtcatacatatgtcaaaacaaatgtgcttggtggaaacaaaataaaaattagtgtgtttgaggggaccggaggatatggttcgtattagatatgatcgaatctgtctaattctatgcgggaattcagttatgctctctagggtgagattttctagactggccagaaaattaatgtggtagcaactaattattttgcaaagttggacatgatcaatgcaacgtggttggagatgtatcataattgtatcaacacttgtacgtagcatatgtacaaatgatactcccaaagtaacgtcccaggcactatagctcctctgaataggctcatatttatccgtcgattcattagcccaagaaaaaaatattgtttttgtcaggtttaatacacaaaaattcagcattagttttcaattggggtgtgtatgaagagatctaagatctttaaagtcatgaatataatcatgaactaatttaacttggtgaagttttcaagccgaaaatagtatggatcaaacacctaaaactttttcataaataaaaaagagtatttaatacaaagtaattatatatattcttcacattaaaatcaaaaaataaataattatatatgtatgttgaatgtaaaagaaataaaatgtcatgtcgtcgaatgatgtcgtgtaaatatatatacctactgcatatatacttaacggttaattatcaattggaccatatatacatattcttgtcgagtccaaacaggtctagggatatttcaaccttacatcttagcctaaacccgatcctaaacagcttggagatcgatatcaatcgaaccaaagatttaaaccatgaacaacagttttcgaaataaaattcatgaacagtcgaaagaaaatttatctgatgaccggcacaagaaatctgataggaccctaatcgtgtttaaccggaaaaccccgctctatttttatttttttgagcaagtaagatatataaccggttctatttatatcctaattgaaaccccttcgtcaaggaatctgcctatatatagtaacatatgcataccaatttcttctcaccccaatacaaactatagaccaaagaaaagaaaaaaaaaccctcctacggtatatttgacgaccattatcctcata

SEQ ID NO: 4632 - DNA, 2000 bp, Arabidopsis thaliana
aatttatagaaccaaagtgcaatgcacttcggatcgtcggtcgactcatctccttcattgtctccatccattttcccattccccactacatttttatagttatctcttcaatgtttaaaataatatgtcaaaacaactctttatcaaaactaaattttcgttacttctggtagtaaggatatttctaaacgttatcacattagttattaatcaaacctgtgaaagacatgctaggttactgaagaatgatattagatacttgtgtacactctattctacaacgatcgaagctagtcccacttctgtgtctctttctttttctgtaagtgtgattgcaaaatgcgaaatattcatgtaagcacaagaaacaagatagttatacattcgcatcactttgtattaataaattgttgagccaattttgttctctatttccttgttttggtcatgttgaaattcaactctatgattgattacacattccggagaatattattttattttctttgaacaagaaaacataaaaaaaaaaaaaaactcaacgggatactaaatgatccaactcacaaatttcaacaaaattaagaaaaaaaatcggaaaacctttttaggagatggcagaagaatttaattaacaaaagggagagaggcttattgaaaaaaataaaattagtaaccttgcatttatttaatttccccttcattacttgtttaaattaataaaactatagactatgatctataatgagtttattgcaaataaggcatttgtcttagatatatattttattttaggcacttttgaaatgatctttagatttaggcacttctttcctggggaaagtcgtttttacccttacagagagatgatgttgttctttctttgttgatgaacttttacgttttacactagaaatcaaaaatacttgcgaccaacaccaacaactttggagtcattgattacagagtgatgtcagcgacgattggaaattcagacgactaacaatcggtcctcatgagatgtgaatgcgatctagatttttaacatcccacattttgagatctggaaaaaaaaaacaagaaacaaaaaagtcccacgatttagtattacgatttgcacgtttttttgttcagtgatttttgtgcaggttaaggaattcaagaagtgattgatactttgttgattgctcaattgatgttcataatcatgtctacaagtacattgatttttgttcatgttaatggtgtttgatgataatgaggatggttgtagtgttgtgttattgtgtgtatgtaagaattgcatactctatatttgacggtttgggtttacaagtctaattctagggtatagcgtttaccattgacgccgttcgttacccctcgttgtcaaagccgtgaaccaccaccaaatctttgtgctatcgtcaaagcttcatgcctaccgtcgaagctgcaagtccactatctaagccatatatctttggatgtcaaaagaaacttaaaattgaatcagagatggggatacaatttttagaagataaacacattcttttcacctcattctcaactccagttcatagtttaagggcaaaaatgtccgtaacaataaaaattgaagtattatatgcttttactgtttagagtgtctgttttgaaagaaatgttttcaaaatgcttgtttagaatataagctcgatctataatatatgcgtttttaaaaaaagactagtatatgcattatgtaattcatggttaattaatcctctggtaagtaaattaaatagcacatgcatgttcaaagaaaaatgtagacaaatatattaaagtggataaataaatagaaaaaaagggagtggtcaggtcagtctcggtgcatgctaactctatgcacgttctcatcttcgtctctttcctcacttacactaattctctctctctatattaaacctctgaaccagtgaccacatacatactcagtaagcgagtccgagtcaaca

SEQ ID NO: 4633 - DNA, 2000 bp, Arabidopsis thaliana
atgaacaattttcttctatcatttctaaaaaaataaggaatgagtaggaataatgtcaggtctacatgttaccatttggagaaaaaattggtgaacaaagaggaacatgttgttcgtgcccatttcttttcgaaataatggtcaccaatcggaccctatatatagttgtaaattaaaaatctactattactatatatggaaatgtaatgtacatgaaatgaatcataaataagttcattttggtttacttccaaataaaatagcaaacaaaaagaaatgattccaacattcgaatcctgctggcgtgatttagattagtaattatcacaacctccaaccacaaaatctaaataaataaataaaccaccacccactccaaaaaacgaaaaaattaacattacgaaagaaaacatttagcattaaataagtttttcgttggcaaaatataaaataattacgaaaataaaagtccaaattatactaatatttatgacataggagagagagtgatggtagtaagcggaagaggcaatctcacgagagttgacgagaatttatgaaataaccgaagagtcagtgatcatcttacacgtggcactcgcttagacattcacgtgatccaacggtgatcgtaggcacaactttcgaagaagtaatatgaaaatagaaaattaagttaaagggtttgtttgaagctattttgactttttagagtttttatttcttaaggaacaaaagtctctatattcatagatctctttatttccttaattggtctttggtaaaatttccacagttttgagattataattcctaagatggaaagttcaacttcattcccacgcgcaaatatgatctataattatttttgattaaaagttacttcaactaaatagatagtacatactatgagataatgagactacaataagtcccttaatgatgttacggtttttttgtaaacgatttttacatcagtacattttttctggttttataataatgtcgtattgacattttttatacaaaaaaaatcaatactttatttctttcatacaatttgctttttttttttaatttttctttttttctagagttaaattaagttaaatattttacatcaacctttttttattaaatatgtaaaccataacatttgaaaagtttataaacattatttaatttgtaacaaacgaaatacaatattgtgttactatatatgatattattttatttaaagtacgttacaatatacttttattacaattaatcgaataaaatttttttatgagattttacgttattaaattaaaataatgcacaaatacaaaagaagttttggatccaaataataatttatttttacaattttaacacatacacaattcaaaactttgaatgtccatctaaataaccttttttgaccctgtcaaaattcaaaattccacaaaagaaaaagaaactcccccaactacaatattttcctttatcaacaaagaaaaaaaatacttttaaattcgaactcacataataaaagcaaactactaacggtaattctaataagcacgtgtcgtatacgcgcttgtttacgagagtaaacagtatacacacaattcaaaacaccctgacctttgccttcgccactagtcaaccctcttcttcttctccgtcaagagagcaaaaaaaaaacttttcttctttcacaaatttgtttttcctttttatatttaacactcaataacataacagaataatattataataatatctctcatttttcatttttctacatctttatattctcttccctttatataatttccactcaaaaaaatcattttccttgcacacaagtcaactctctctctctcacatcttcttcttcaacctctgtctcttcatttctctctaccatggatcaacaatctctaatctaaaaacactttcgttgtatctaaactctccatctccaaaagaaaaactttttttcttcttctcag

SEQ ID NO: 4634 - DNA, 2000 bp, Arabidopsis thaliana
accttcttctttcccattgctccttttcttttgttgtttggcttttacatttttccatttattctaaaaaacttatttctttttcccaacatatcactatttaatttatgtttttttcactttgcactgtttccaatttttagcagaatcagcatccgaagttgcgaggacctaattagtctcaaaagtttcatctcattttttctgttttgtatgggtttattacgctgattagatagggaaaaatggtatgcttcagaagacaactagatgtgcaccgttgtgctcacatgaaaagacaataaatatctctttcacgttttttcggctagcaaatcaacaagaaaatggtggtcaagtggaaatatattatatctatatatatatatattatatatattaatgaataaaagcagtgtcgaaagtcttgtaaatcagctagtaaaaggctgattgtcgctgaaaaaaatgtttgagacattgttttttgtatgatcaaatgtttgtaacaaagttcttttagtaataagattcagttgggggaaaatagcatatggagtcttaattagtattgagactttaaatatgagagaagaggtaaaaaaacaaacaacaagaagtgaatatacaataaaaaatcaaaagaggtaaaaacagaagaagaagaagaagtgaattttacaaataaaaatagataaggcagcgcgaaacaaggattttggtgggagaatatatgcactgtttgactctagtcttaactcgtaccatatgtgattactactttacccctcttatattcatttatcgtaacaaaaagatcgagtaaaatagacagacacgttaccttcgtacacgtgacgtactctaaatggatcttacattgacacgtgtgtttcctctattggatgttttgtttgcttgaactagtggccattcaaagaaagccacagcacaatcataaaattaataaaactctttcttttttgataatatacaccattttttttttttcgtgtgctaaaacctaaacttatttccaaagtctgtttaccattttaatacaaccagaatgattccataactaaaatcgcatttaatacaactttcgtatataatatggttattggtttgaagactaattaacatttcagtgtgtgatttactcagtattacaaaattgtatgaactcaacaaaaatatttgttataaacactttagcaaaccaacaaatcatcagtgttttttacatagaacaaaatgatcagtatagtttaaaagttctttacattattttataggattatagatttgactatatataaagacatgtatgacttatgttcttcacatattatcaaaaccatcaaagatgaataaaagctcaataccaaaaactttcatactagaaaagttacaatctttaccaaaaatctagtatatgatataaacatttgtacttattctgtggttgtagaatatattccatcacataaattttaaaagctgatcttatacataaactaagactaaagttgtttaatcaccaggtccagagaatatagttccagctttattctactaaactcaaaaagtttaattttgatattcctaaaattaaattaatcaaccaacccatacaaaaaatttcattctaaaactatagattaaaaaaaagtaacgacgttgatcgcatcacatgactctctctctcactctttttattctgtctccttctaaataaaaactttccccttcctcttttctcactgagacactgtcttcactcttttttgcttatcaacaaactctgcacaaatcttaacctctctgtttcttctctttaattctctctttcatcgaaagaaacctcaaatttcaaatcttcgcattgtccgccattcttatacttcccctagagaagcttcttagggttcttagtttcttcctctgccgcgtcttctcaagtttaaaacttgtctcttcttcttcaaatccaatca

SEQ ID NO: 4635 - DNA, 396 bp, Arabidopsis thaliana
ttcacacaagaatctctctttttcattttaagtttgagaccaaaaaaggtcgtgtggatgatcatgaaatctataactcttgtctttcattaatcgtttttccttggatgatcaattaaataaattggaacaagacattctttggattcatcatgtcagaattttatttgtcgagacaattttgtcacttccaacaacttaaagggtgtaaacaataaatagcaaaagattttaacttttagttgtctagctgtcttaagaaccaattagttccgtttaagtcccaacagatttcgtaacggacaaagttcccaattctttttttttgcataataagatctgaaatcggagatagaaaaaaaaatcacatttttatttccgccggaacaaaaagcg

SEQ ID NO: 4636 - DNA, 1359 bp, Arabidopsis thaliana
cttttaggaaaaacgcaaacaaggtattcaagactcacttttaatttaccaacgagactttcctttgctagctgtgaggactgatgagttacacaaacccctgcgacactgtatttatagtagctctagcttttagtttgtttattttagttacagttaatttatagtaattaacactcggttcgcgtttagccaaggtgttgccggcaaattgtactaacaagtcaatattttaaggaccgactttgatcggaacaaggtttgtttttttcggaaagtgtaataaaaaacatagtacatgtccgaatactctgcgtttcgtcgaccaatggattgtcggtgtggacggtccacgttatccaataaagagagcaaaagcactgtttaaattgtttagacattattagaaaaataagtttgaaaatcttactgctaactgaagtgtcttgattgggccgaatcagaagatgggcttacataaacataaaagggccagtattgggttaaacttgatggttttggttaatgctgctcacgtcattggacttctttacagccccaccactaaaaaaagaagaggaaccaaaggtttactcttcctgttctagtcatgagcctaaacccaacaagacatgggtgtttctctaaatctgttatccatcattagaacttgaaagaaatcagcagttgatatagggtcttaaacaagagagggagaagtatgaagatatcatcacatgtagtaatgaatgccgtagatgtgacagagtcgttctcacatggatgtttcttagctaccaatctgctgaatattgaagatctcatcattgactgaaatcaacagtttaacatgtccgatgaatgattaataggaacacaattagctagatagagtgtgtggtaataaatcacttgagaaaacaagagaccgaccgacatcaacatgtagtaccaggcccagctgtgaggcagagcagagagtcggtgcaatgccacgtcattcaccctagactattgggtaatgtggtggtagctctagctttcacactaccttttttcctttttacttggaatgatgatttataggctagacacacactacacattcctactactcaaaactctcaactcaataaataatgaacacgcctacccttgtgccagctgcttctatatatgacgtgacgtgtgctgtgatgctgagctggaacccattcccttcttcttcttcattcttttctgttcactatttatatatttgattcactctctccttcctctcctctctattcatcgcatcccccacacacctcattaacattataattgtttttttagttattcttcaatttcaagaaa

SEQ ID NO: 4637 - DNA, 2000 bp, Arabidopsis thaliana
gtagaaattgcatatccttaatcagaaaatagcattttggttctacttaccgaatcaaaccaaaataaaccacaatcctatatgtcaatcctctggatgtaattaaccattatgatcgaaattgttgattgaaactagacggcaatacagctcagggtatttgtacttttgttaatagattgatagcaccatcctcttatggtccaacctatttcctaacatgaatttttcatctgaataatttagacttgtattaagaccttgccttagcacctttttacaaaatttaattattattctctctgaattaatgaaatttatatgtatatcgcctactcatgatctagtggacatctactgtttagctaattcaatattttacattcggatattgtgttttgatgcaaaaccaattacaaaaaagaaatctagggtttggaagtttttgcattaagatttaaacaaaaagttaaacacctcacaaaatttatcacgatactaaaataattttcttatcaaatcacatgttactatgtcagccggagaaaaaagactcacatgacatattatcacatcgattcacagaaacttacatcaaaatagaaaaatcacgaaaactggtaagggtttttaactttttatgaagacccattttgtgaatcttcacattcaaactacaaatagtcttataaaactagtcgcaccggcagaaaattattagggcaactaggcaatgtaagagacgtgagatatctttaaagacgataggaacacgtgtataaacatgattggaagacaaaactgaaactggattctgatggatgatttgacgacgtagctaagccaaacaccacgaggttctaagatgaagcacgaccacatatttggggtgggccttatctatgacatgttcctacttccctaacttccatggtcctacttctctctaatcgtacatccacttttaatttcgtttcttatctgtcaattattcacatgcgttgcttttttttctatattcatagcattgtcttcctttaattcagaatttttaggcttttagcatgtgaaactttaattttgctatcatattctcattaaccaaaccaaaaagtaagattgtttttttctttttgaatgagccactctacaaattgttgccaacaaccaaatatatgaatgatgattggttctcactaatcattatactttataaaattttctaatcatcaccatatgcatgttatgaaatcaagaatttagatccgttctgtacttctggtctgtcacacactcacactttgtcccggcttctatgtccttgtacgatgagattgcttacacatagcagctttatgataagaaagattttcatgttcgtcatattactataatcattgttatcctgcatgttttttgtagtcttttaaccttgaatatcactgtaacatttactaaaataatagttgataatttgaatgtagttagccaaatatcaattagtaaacgttcacttttcttttaattttaattttaatgataaataaatacatttactaaataaaagcgtagtaaagcatgttacttacagagatatgtttattaatgttatctacaaatcaccaagatcgagatctctgttagtctattatcaaaaagttggtgaaacatatatcggtatatatgtggaaggtctaaattacataaaatagccgtcgatacaagtacatatccaaatagggaaaagttaaaaggaaatggtgaaaaggaaagtaaacgacgaagacaaacacaaggattagagtgagttaactaaaagagataataaacacatcagaaaacgacaaataaaaacttagaaaaataagatagaagaagccaatcacaaatattattacattagcaattgggtggattggggggacccatgctaaagaaatttcaatatatagacactctccaattatgcttccatctccttcaatagagaaccaaaaaaa

SEQ ID NO: 4638 - DNA, 2000 bp, Arabidopsis thaliana
gatatttgttattcgattcgttttaatcgaatacttaattttattatttgctttgatccgaaaatttccaaatatccgaaaatacgaatatccggatttttgtatgatatttgtcggatatccgctttgctttgctacatccaaatatttttttatataaattatttaacatagatttcaaatttcttaccttatgacttacgagtgtgagattgagagcaactgaaaattttctggttataaattctgtaaccaaattgagtgataaaaatagtgaaaggtcgaagaaaggaaacagaaatgtcgctcttatatttgatggattggaaagtaaaacgacaattttaggataaaatataaaaaataaaacaattttattttaaaaaattccacttctctaataaaaactgtgtcacaaaaaaaacacaggcccaaaggatacaaatacaagcccaaatcccaacatatacaaatgcacaacctatattgtgatatatatatatatatatatatatagatcgaagcgaatatccgactttagaaaaaatagtatttgttatttgcttcggtttttacgattactacatttttctatttgctttgctccaaaatcttacgaatattcggatttttcgaatcaaatcaaatcgaatattgagttaaagcggatcgaacgaatattttgtccaggactagtgaaggttgtggacgttccacgtgtccctagcttattattattggtctgacacgtctatagcttatctcttcttttgtgtcgtatgagcctttatatgtgggatgtcttgggctttattttggttttctcataaccaagcattgtactggtaatgataaaatgaataaaatattacacttatgagaaaaaaaaaaaaaaaaagatgctaaaaatattacatatttatgcagaatatagaataaatcacacatactgatttaataaatgctctatcaactctgatatataaggagattttgaaaagaaaaaaacaaagaggagacttttgttgtgcgacagtgattttagtaattttggcaaagttaagtttgcctttctttgtttggtaaagtcgttagggaaagaaacaaaaactttttattagtgaaaacctcgttagactgatttttaagtttcttcgtgaagtgtgttgttacccatttatcaagttttttttaaccgtagttgagcaaataaggacgagtgtcatgattgtggttccgtcacaaacttatcgactgggtttggccatgtaggtgaataggtaggaagacatgggccttagtcttatcatattatgcattaacataggcccatgttttgtttgtaaaggcccaaataaactatgaactgtccttgcatattacctcaaaaacctttaatctctcttttggtcttgttttctatttccatttctataccattcaaaactataacttaatttcagcatcattaaagcttggaatgggagtaattttcaatgagctggtttttgttatttcaaaaaaactcactaaacatccaatcaaaattaaggaaattagttttcataaaagtgtgttttttaaaagccagatttttatcatacgaaaatccaaaaaaaaaaaaaaaaaaaaaattaaaaaaactcttccaatcattattttagtttgtaaagagtccaaagacaaagatccagtgagagcaaaaaaaaaagcggcgcgctgcataaggattaaggaaggagccggtgaggtggagaagaggataagaataaaaccgcaagagccaagtcagcagtcatagcggttaggcgttgagaaaatataattgacggacccgcttcccgtttaaagccgaatatgctttcttctttgtctctcatttattcctttttcctttccttcttttctaacctttcgtataattacattctttgcctttctccttcttcttctttagatcctaagtatcttactttcctttttcatcatcttcttcgatc

SEQ ID NO: 4639 - DNA, 741 bp, Arabidopsis thaliana
ttttcccattgaatgaattattagaaaatactaggatttgatttccacgtgtgttccaatgattttttatgtaggtgactctgttttttaaccactatcaaaaagttgtataaagttttatttttcaatacctaattttgtgtattgacaatgagagatcactgatcaccaacattttgtagttttgaaaagcataagcaaaagctgcaataccatagcctgaagctaaaagtacaatttatttgatggatattgatttagtagtaaccagccgaatcgggaaataaaatataaaaaaggccataccaagtccagcttaagcccatcagagtaaaaatcttggaccacaaacaattggcccaatgtaaaaattggactaagatcccaatcttatcgcgattcactgtaagaaaatcataacgtacgaccacgattaaaattcaagcgtggacgcgtgcacagctgataaacggacgtggataaaaaaaaagtgaaatagcaagtttcctaaatttctccagtcccaaagaatattccaccaaaatttttaattaggcggcatagtcaaattagggtttaattacattccccactaaaattagggttttctcattaatttcctcttaattacagatttaatcccactctacctctatatatatatacacacacacgcctaaggatttcccaacttaaaaaaccctaatttctcaatctcttcttcaacttttttttttaacg

SEQ ID NO: 4640 - DNA, 923 bp, Arabidopsis thaliana
ttgacttgtattcaggtatgatcagttcaaaatcagtttgtaggatctaactgtagtataacatagtatgaacgatggattgttgaccagttggatagaggagaaggaatcagaggcaagaggagagcaacaaagtgtatgagattaattagttaaggttaagaggcacattttgtcaaactagctactatggcatattagtgtttgtctaatcccttgttattaatgaatctgatttgttgtttgagttatcatgctatgaattgagtctttctttactaacaagtagggatggcttgcaaaactaaaaatccgtaggtatgatcttttggattaaccctttctgggtcatccttcacgaacaaaaacattgatttctcttcgcctcatggtcgacacaattctctcctctaaatgagaatcgcaccaatgataaaatctttcacacttgagttgagttatgtccttcagaaagttataaccatcgtcaattcgtcatcaataaaagagatgctgagttctgtttggagtatgggcttctgtaatgagaaaaacaaaaggtagagaacaaattggtaaaagaaattacaacttggttttaatctaaaataatgtgcccatgtctataaataattccaagtattgaagtatctcgaaactttagagttaaataatattttatattattgctttttatgtctcaataattcaattgtcactcttgcgttatccatttgaagatggatccatcactatgacaattatttttctgccaccttgacttgtacggcttatattccaaaaatttcttttattgttcacctctttttcttcaatccttcaatttctctcaccaaccctaatttccccaaatttggtaatacgatttcgtcaatttacttcgcaatcgattcaattcaatt

SEQ ID NO: 4641 - DNA, 273 bp, Arabidopsis thaliana
gtttccagagaatattagagaccttcccattgttggtgtcgccggagaattttcgaatttttgttgttgttcggtttttggtttatatgaacgcggccaagtgaacggatggtggacatgagagagtccaaaaagctgatagaacttaaaattgaaattaatgagaacattgaaccaaaatcaggttaacaaataaccagagataaccggtctctgtagtatactcaaatggttagtttttgccgatggtggtgccctaaactcgaaaaaaag

SEQ ID NO: 4642 - DNA, 1865 bp, Arabidopsis thaliana
tgttgggtctagaaaagatgattgatcagtctttttacgttaaccggagtgtgtgtccatatgtatacagtatatatatatataaaaagtttaaagtaatgtgtgctataatgggctgcaagtcatcaacttaccctattttatccattttaaagtttgatccaactatgattttatacatatttaaacttttgtgttataaataacgctctgtagaactagtccaatatacagtactcttttcggttagaagttttgaaaaggcaagatgagattttgatttatgaagtagtccaatatatatgcacctactttgtgaagttttcatgtttagtctttaggttgcatgtaaatatgtattgtttgttgagtgcctaataaatgatatatactcattgaacaagttgtagaagctcacgactgcgaaattacaatttatacctgaacaacactatagatggagaagttgtgtgttgttctttaacaaatgcatatatatggtggtgtgtagaataatgggatgcaagttatcaaccttgcctattttatttctaactacacaattagaattttttatgataatcttatagctttcattactgactccgtccaaaactaatattttttattactatggttcattttatttttgaaaaaaaactagtgaatgaatgaattaaatgtaagtgaaagagataaaaaaacaaatgagtgaaatataagtgaaagagatataaaaaaatataagaataattttgtattgctcattcttcagcataaaaagagagagatatttttctttaaaatttgcctatttttagtagtatattaaacataaatagatattagcaaaatatagataattgctttattttacatcttatctttctaaatgggcaactatatacttttcatatatatatttttaaaaatcaacataaattttttatttttcactagtattatatttgtcgatcaacttgggaaatgaggaagataatactttttgcaaacaagttttctgactttccatttaaaggtcagattcaatgtgaaaagcaactagctataataccatttaaccaatgatgtgtcaccacgtgtcaatattggcgtggcatagccagtcccatgtgccacgtcacgtggcagatcccatcgacgttggaatctattttgcttctccgaaagcaaatattcgcacatttaatgtacatctacacttaataaaagcttatttaaattaaaaatcaccccaaaaatttaatatatttacagtttcagtcccttaagtaatagacatcaaaacgtgcgattttacaaaacggaaaaatgataaggacttactttagagaaagagagacagataaggacttaaatgcaatatcttatcagatcgtgttgccgtcactttcctggaaagatacaagccattatactctaaaagaatataaacaaaaacaaatatattattcaacattggaatatatatactgtatgtaaaggcttccttagagaagtagaagaagagaagtatctggagagagagaggcgtgcgatttccgcatcgaagaaacagtacggagttttatccgctccgattctggtgagtttttttttttgccgatctcgttgtccgtgttcttcgctttctcggaatttgagtgtttttggattcttcgtatattatatgttgctttgacactgatctctgatttgatttatgcggctactcgatttttgaaatttgatcgttgttttattcgaagattcgtcgtttgttttcaatctctgttttctcatagtgtaacttgaagctgacaattagatttgaatgattttgatctctttgacagtggaagata

SEQ ID NO: 4643 - DNA, 2000 bp, Arabidopsis thaliana
ttcaaaattaacacgttcttaaattggtccgaccgatccaatcccaagttcgatcttatgataaggttttgttgagataaatgagtaggaaagtctatcatctcaaaacgtctttaaaatattacaatatataaaaatgtaacaaaacatataataataaatcatggaatcaaaccaattatctactcattactaattttgttcacaaactccaaattctctaagtgtcacggtattaggtaggttcgtattggattattataagtaactagattagaaaaatataagaaaaataaaatcaatatgatctgactatgacgatgatgccgcctttctcattactggtttttaattcgtactcgtgacagtgtgtgttttttctcttacttgatagtattacgttaattagttatgagttctcaattcaaacgttggcggggtacatttctagtattagaaacatatatagctttgcattgcatgtaaccaattcttcaacctcttaataatcagattctggacgggataagatcatttgtatcttttgcgtttaaatattagatgatctacctaccatcgtcttacgtattctcgatttttttattttaaaagagaccaaacatatatataataataaaatggtttggatctattatctatatatgtttccttaacaacttaattagtttaaggcttaagcacagttgacaaacatctaaaattttgtccaccagcccggagatttcatagttccattctacccaccaaaacaagagccctttcaatatatatagggctattcaaacatgaactttaaccccacaaatttttttatctattattattgaaagaaataactatgattcgttagatatcatgattctataattagttggacgatactaatgatattttttcgtaattagataaataggtaattttgtgtggatagttcatttggtgaacaaagttctcttgcatacaaacttttcactgggaaaaacagtgtatattttatcaaagtattatcaactataattggttccagatctctaaagattattataagatcaaaaaccttttctgtagtttttgtgtatgaaaaaaagattaatagtttagctagaaaacctttaggaaatcatcttttatgtagtcaatctgattatgtacacaagaagtcaataaactacccaaaaaaaaaagttcaccaatttcaaaatacttctatagttatatttcacctagaaatagcatcatgaaccaattatcaaaataagaataaacagaatctttattaaaaaaaagtaccccggccctttatactgtcttttgtgcaaattgatgatggtcgtatacagtgtgcgctacggcaaggagacgattatattgattaaaaaaacttctgcatacagtattgcgaagttaacgtcgacgtttgatatgtctttgtggatagcgattacatgtttaagtcaattgagtttaagtcccatagacgcgtttatgccagtaagattattaaatttgagaaagaaaaaatataaagggtagactagttacgatttatgcgtattcgtaaacctattattttcttgctatcacatttaatctgtgtccaatactttgtaccaagattagattgtagactgatttttttctggttattactgaatatcacactaaaatttgtttcgtggtcaaatcaaagcgtattagtatacacgtcaaaaagatagcacaaacaagaaaattaaaattcaaaattgagaatatatgacggcatgatcgttaccaatccattggttggtataaacatatatacttttcttttttgcttcaactacaatgaaattacatattaatatatttgattattaatttaaattaaaaaacataagtccccacatctatataaacacatcgattcaagactcaaatctcatcaatcaaaatcttcaaacacaaacttctcgtttctcaaaacatttggtcttatg

SEQ ID NO: 4644 - DNA, 908 bp, Arabidopsis thaliana
ttgacgtatgtaggatctattgtgtagaaacctatatagtttcttacattccacgtgttcatggaaaataaaagtattctgtggtcaattagttggatgcagagcaatgtcacggcttctatagaaagttcaacagaaccaaaatttcactgtttccatctctccaatgttggtttcttgaaatttagaattggtttggtgacttggtcatgtagtgggcatgtgttgggcctcgtcaaaatgttgtctttctctgcattttaaattaaatacccattaacaaatctgtatacatatgttcttcactgtctgaactagtaattcagcataagctaaaagtataatattttttttttaataaaaggactgttgttaaaaacgaaaagtttggatttcatgttagtgttggtaccgaatctgccacgttttgatgattatagttgtagaaaatgtcaaccaagcaatattattgtaaagacaataatggatggaaatctaagaatttcgattgaatttttatcttatcgagaactttcaacaaaaccttttggattgatcaaatgaaagagacataagtggttatacattagacttgttcacgacactccaatgtagtatgatttttctgtttgtttgtcaaattcattgtttacttgtcttataggaattttccttattttacaaaaacaaaagaaataaaagaaaagaaaattggtgcttgtttttccaaattagtacgctaattttatcactattgtatgcactattttgttatttgactttgtaaatgcatgaattaaagagtgtttaaaaatcagtatcttatactatattatttaatagcgcacggaggagaaaccaaaatatacacaaagttagagaaaaaaagaagagaaaaggagttatat

SEQ ID NO: 4645 - DNA, 2000 bp, Arabidopsis thaliana
aaagaaataatgtaaatgattatttttttgggctcgttgcaatatgattgttaaattgtaattttcagttgttttgagctgacgtaaccaaaccagattgggtgggtcttttcttttctgttggatgctactgtattggatcgaatctgtccatttagagatcttctaatggactactagattaagcagccctaggtggtaggttatgcattggaaatactgtaaactgtaaaggcaacaatgtccataactctaagaaaataatccatctaattcagaacatcaatatacccaaatccagttttagaaacaaagtaaaaacagtataaaaaaaaagccaaaatgtgatgagaagtcacatgtcatctcgagttgatattccaacaagttgctaacattaaacaacatgggatagcatatttgatattccaattcacaacatgagcatgcccggtccacaactcaagctacccaaacaatggctaagatcatcaaaagagatgagtaaaaatacaaaatattataggtatttgttattaattcattttttgttggtcttttttttaccatatcacatgagttttaagctttaaagttaataaatactaattaagcggattggtaatgaatttttagtaaaattttggttagaaaaaaaaaaacgaaaacaaattttttcttcttctttttgtatgaatataaaactatattcaaaaagacgtttgcacaaaattttaatttcgattgattccattgttatttatttttatgttggcttggattccattggtattaaggtaagtgattttagtgacaaaatggaagaagttgctttgaagaaaaataattgaaaacaaaaaaaaaaaattgactattgtttttattttcttacaaactatttatggatttaaaagttgttttatcaagttttagtatgattttttttatattatattattagtaaatttgcgagaaaaatataaagagcatggtttttttctttacgtaaacgttcaaaattatcagtccggctctaaacatgagatagtagattctaattctcgtcatgagatcgtagattctgattgacaacaagagataggagattcctgtttacagtatgagattgtagatttcattcacaacatgacatcatagatttcaattcacaacatgaagcaaatcattaattattttcaaatgtcataccaatctcgtcttctcgaatgtttggagcttcatgaccaacctttgagtaaagagcattacaaagtcgtaatcgttttaaaaacaagttaaagatttcgtttctttggatgattttatgaatagtataatacaaatttacacaactcaccacataatatcctttgtatgatccaaccaatttcagatggagaaaatatagttgcatgagtatctacaatctaagacacaaagacatagatggatctaagggagactgaactcttgtataatggattcacaatcacaagaaacaaggagagaaacacaaattgaacgttattatttccagcttaatggacttgaagaatgaccatcatgtttgtgcctaatctgattttctccaaattctttagaattctctctttgctaatcctgaccaatatgagaaattcaccatttttttgctcataggtgctatcaataacagtttcaagtttcaacaattcaccatttatataacattaccaacagtccaacactagtaacataatcaccaaaatatattagtaataaattttcatcacagctttatatttttgtgattagaaattaggatcttacagaaatctttcaaaaaaaaattcataacagttccattttttttggtaagattcataaaaaaattcaagttaaatgcattttataaaaatgtaggaaaaactttcatcaaaaatcgttgagaagaacatacagtatatcttatccactctcttcctcatccacgcggcaaaggcacaaacctctttagaaaa

SEQ ID NO: 4646 - DNA, 1202 bp, Arabidopsis thaliana
ctgccaagaaaggaaaacaagctttgtttgttgatcctcagtttttacctttgttagttgctgtgtttttaattgcatcagtagaacatcatgtaaataaaaacaaactttgttgctccaccaaatttatttgacccatgtagatttgaacacatgaatatgattacttccacaagtttgaaatctaataaaagctagtaaagataatatcgagttttatcatattctcaaaaaggtgattgagatgtgacaaacacttgatagacttatacatgttttgtaactatgaaatatgatggtgatcataagcaaattggacttgtataaacagaccacaggtgatgttgatataactatcgttattcaccttaatttggacccaccatttgcttcaacttgtggctcctaatctctagagactcgtagcgacttggcagattccaattggctccttggatctccaccgttggccaaatcagcttgaccgacttgatgtggaaggaaacaaagttaggacatgccatatctattatctccaacatatcaccaaaaaagacacctagcatcattcgaagataacaaatggttaagagtcataatctttttaacaatgctaaacagtgatcatttaatttttataattgaaatcatgagacgatgagagaaacctgaacagttagaacatggcaaaagttaagaatcaagataaacattaggctaatggtcaagccaaagagctactaaagtttccagctttaccaaaatagtagtagatgatacaaaaatagttagaagttgcacgtttcagaacctaggtaacatgtggatgggtcctatagaagattacataggaagaggtgtttacacttattgaggaagaaagagagaaaaagtagtaactattggtgccattgcaaagatataagaagacaattagtttttttctttctttcacatttcgtgctggttgatgattccaaagctgtaagcatctctgcactggaccccttctcaaaaactcagccagccacaagatgatcactcaacatcaaacccacaaacttctcgccacgtgtccagccctcagaattctatccttcctttccatttccattcaacaactaatatagccttcttagtcccctgctgcctttacatacgatctcactcaccatcaaacaactacaacatctgcggttagt

SEQ ID NO: 4647 - DNA, 1490 bp, Arabidopsis thaliana
ctgtttccaaagttccaaacgtttcactcaaatgactcctcagtctcccattaaactgcagaagcttgaaacgctcaacattttttttcactgtagaaacaaaaaaaatggtaagtcataacaaataccaaaaaaaaaaaaaagtacatctttcttatccacacacaatgtaatagaattacaaaacgaatcttcatagaccttatagatccttaagaatccgtaagatctgattagaagaatctctacaagattaaagctgaggaaaaaaagtaaaactaaagtatcaaaagaaccaaaacaaaatcacattcttctcaaactttcttaatttaccaaagaagtactaaaaaacaagattagtaacaggaaaggcctaaagcgtacacacacaaagcaggaatcgatgaattcacataacactaacaccaggactaacacgagagtgttattggcagtgtcagagagtgaaaaagcttggaaaaaaatcgaaccgtacctgaacggaatcagttcgtaacacagagactgaagcagattagagttgaatcagatcaggagaggaaaaaagaagaaggaagaacagatctcaaatcgtccgtgaaatccggcagaaatagcgccgacgaagctgaccctatcagctacagaggtagagagtaagagaagagagagattgagctttgttaattgtgtgtagattagagagtgacaagtagagagagatagagagttgttgaagcgagtgtgttttgttcgccgagtctttcgtcgaagttgttttttttttttcccaaaaaaaaaaaacatatctttttgtggccgacggatttagtaaaaaaaacagtataatttttataaagatgggcccaatagtagaatcgtacgctcaagattccgtaatgaacgcgggaagttacgtcattgtgaccctacttacttagtggagctcaatgtccaatatacaccgttggatttgtttaatcctcctttagatgggcccagtttttagtaatattctattcaattcagcacgttatacaattgcttttaaagcccatggcccataatactcagacagccttaaatgcttcagattaacaaagaaaatgttttagattttatggatagtgtgattagagtccaattattttggaatttaattcggttaaccagtcgaaccggataatctgtagaaatccagttttttttttggaagactacatatttgtctaaagcccatgaaggcccattaaacccaacgaacacaaacaatcttcaaaatgctcctagaattttctggattcacctgatttttctcatagacgtcctctagatgtttctgtattccccataacaactcgagaagctcgagaaatttcggttagtacctttaaatagcttcaaaaatccttcgtgtgttctatcagaaatcgaaaaatcaaagttctcaagaagatatcaacaaaaaaaaaagtaaattctttaaa

SEQ ID NO: 4648 - DNA, 2000 bp, Arabidopsis thaliana
tgcctaaataaatcagccaaataaagttatatgttagtcgcaacatgaatactattacagtaattaaaaacgaaaaaacggcaagttacttcagccgtttagcaaacaaaataaaacacacacacatgattcgattgctaaccaacacaagaaacaaaacaaacacatctttgcctataagataatgtgtataaaccatacaactagtgatgtgacggaggacaatgagaagactatttcattatgctgaaccgtccttgacgtcttagcagttagcactgtaaaatgggttcatatcatagtaaacgaatcactctacacaacaattacatgctaaaaactaagaagctaagttaccaaattctctatagaaatagcaatcacttacaataaccaatgctacataacaacttttgagtccataactgataaattgatagaaactgtttgaatttgcaaacccaaaaccgtttcttaggatggagaaatgggtttgtatttttctatttccgatcaaggaaaaatatatcaggcaacaactgcggaagatagggcattttgggatgaaggaggaaaccatagttaacaagcggaaacaatttcaaaggttgatttcaaagatcataaagtcaaagtcaaatccccatagagagactcggttacggaagtgttggtatccgaatatccgatagtcatagcctcagaacttatgttagaatcaataggtttaaccatgcagtgtgcactttggaaatcaagccaagaaaagctatccacgcaaacaatttgcgttagagcgaaatcggataaagagaaagaaaatataggatttaaaaatcttatagcgagtaagacttatttgaaacatcgtcaaatttacttcttttggtgtatatttctcattatatggcgtatatatctgtttatgtaagaaattgtttccaaaaattactgtatactgactttgtaatcttgttttgatatcaatgaatttataaggaaaaaaataaaataaaaatataaagtatgatgtacatgtaaaaaaagttgtttcaagcgtaattgttttttggctagagaatgaatatacagcaacagtaaactaataaacttgcgatgaactaaaatttctggtattcctacaatcaatgaatcactaatttatctataagttttagctatatccgcttaaaccccgcctcaacttgctctctggtctgggtatagttgggctacaacagtgaaaccgtaattaggaaagaaatgataaaaacccaatccagaagcttactgcaagataaagagaaagatcatgaagaggtaggagtgattcatataacaaacagggtcacgttgtcactttctcccagaaaaatacaaatttagactaactatataaggagacgacttcagagtcttctaatgggttagtataactcgggtcatcttttaatctctggctttaaagacatggtaagattccatatatatgaaaactctgtgtgtggtggattgcttttttcatttaaggcaaagataggttttaaggcagaagacaagaacgacctttggcttatttataggagaccaccactttcacttgagtcgagacagtaacgacatttagaatttgcattactcatcttgtcactttctcccaggaaaaaaaaatacaaatttagaccaactatattaggagacgacttcaaagtcttctaatgagttagtaactggggtcatcttttaatcgccggctttcaagacatgtacaatttcatatgaaaactctgtgtgtggtggattgcatccaagacagttttaagacagaagataagaacggcctttgcttatttataggagaccaccactcctctcgataaccatgactcgagacattaacgacttttaaaactaagggacgaaccttaagcaaaagctcttgcattactcaaattcttctgccacttggtaagtctttttctctgccccttctgcatgca

SEQ ID NO: 4649 - DNA, 1118 bp, Arabidopsis thaliana
gtctcctaagccaagctcgccgagtcaacaaggatccaaaagagaacgagtcaattgatcgcgtccaccgagtcggttacgatgaagaacaacggcattacaaagcaagagatgaacaatgcaaagatcttgctctcaatttggtctctctcgatctaaatctgagattaattgaagattcaaactgttaaaccaaatgcttcgataccaagggtttagacttttgagcaaaaaaaaaaaagagaggacgcgttattttatttgtttatttatattataatctttttcttttaatgttggaaaactattattcctgcgtaagtttatttccaaattgattttttgatacaaataatttagcgactaaatgtgacaatttttgattattcattccatcagcacttgtaattaatgaagttaaataagtgttttcctaattttgaaaaatacaggctacgtgctaccaaattaattcccaccaaactctcataaatatgattcgaatactttatgggttcttacgttttctcttttacaagagcttatataatattttctgtatagattaacctcaaaccaaatcttgactttttttttgaagttaacagatgacttgttctattctactagagaaatgaaattattatttactagtctacgtggaataaaaacagagataatggatttgggataattcaaacgaaatggagtcaaattgatgctagctactaccgtctttgaaccgtcggttgtcggtggagtgggatgtggccgaatcttttttactgtatttacaaatttgaggcccatttattttcttgggcttttcatttcttcaatgattctagaactgaaattgctcaaggtattagttcaaacttaatcgttattgggcttttccatatgttcaatattcttagttatgtttaattaaaaatatatgcacaagtgagagaactcaaatgatgaacaaaaagtaataatatttagagaaaaaactaaaagaggaacagagcagaagtggaagtctcttgtccctctgtaaaccctaaaatagaaaagcaaatcacacttgggggattcatgttctttggctttcttacaaacctctagaaata

SEQ ID NO: 4650 - DNA, 2000 bp, Arabidopsis thaliana
ggaatataaagttactaattaacttaagtaaagttggtattgcttatatattgcaaagtattacaaaccaatcccctctgtatattgttttaaaccatagatttttttacaattaagtttatgatcaatcaattatttcaccatttctattaaattatgtaaaaagaaaaggatatatatatatatatataattaaataagaataaatcaaaataccgaaattttttattatccattctttgtggacatcgcccctaatatataaaaaaaaaaaactttcgtataactgatttatatttttttgtaaaaacttaaaggaagcctaagaaatatcttgtgatatttttgacaaaatgtggtatatatctttttataatatcatttataaagaaaatattgattacatggtgaaaaacattttgctagcgatcaacaaaattaaataggcacatgttaactgatctcatacgaccttgaaattttaatctttgtgtcgagagaccgatctttatgcaaattatgaaactacacatggtttatgcacggaagatcacattgcatgtataccatattataaaccaaaaatgatcaagaagaaggcgaaaacatttgggtaaattttaaatttcgatcatgcgattttttagctcatcatcaacagacaagaaactatcttttgtactgtaaatactaaatacaaaataaaatcttcatcattttttgcatgtgtcaaataaattacgcgaactttttttttttatcgactattaatagagaaacctgttttatttgccttgatttggaaaaatggagaaattgacttaagacttagtctcggtcacatcggcaacaacggagcttaaacggcgtccgcaacatggaaactcaagccacgaatctgatatattgactatagaagtagtaagtaactttgactcgtcccacatcagtttcaatttccacgagggtatttggcaggtgaactctctacgtacccaaaacataatggctattttatttcataactgatatttagcaattaattattcgtcctttttaaaccaatttctatagttgggaaaataatcaatttttacactttcaatgtatacgttacagatttttttttattagtcatgcacatattttcaatttttacactttcaatgtaaacaatcgattcttaattgttaaaaataggtttacgtaaggaattaaagatttgtttaaaatatgttccggccggtctaataatttacttgacgttaatttcttaaacacttttagataggaggctttgtttatcccaaatgattttgtaccactgcgacaatactagctagacataaaatgttaataaatttttattaagtaatataatcgaagtattagatcaatgtagtagacagttaggttaactaaaacaagagtaaacacttttttttttcttttcaggataggtaaaacaaatttcacactattttgcgtatttccttaaatttgttgttcgttttctcagcaaagatgaatattttgtttcatagtaattcacaagtataaactcgccagaactcctcaaacagtgaaatataatatagcttttaactgtttttcggctggaccgggtttttaagtgcatatataacacgaggaattttggcaggtcaccaacaaaacttttaaaaatattaaaaattcccatcaagaatagaaattaataaacaatgatatctctaataatatagatattttgaaacgttaggaataatcgtaataatgttcaacgttggtggtggtactcaagatggaccctccctcccacattttcctcactccttcgtaagtcctttccacgcataagggtattatagtcatttcacataaactaacgactactagacttgtatataaataggaaggtgaagctctctctttatccatgcagagacaacagaaaccacaacaaaaactttgagtcctcttcttctctatacacaaac

SEQ ID NO: 4651 - DNA, 932 bp, Arabidopsis thaliana
ttcgaattgccgatcgtcgccgcagcaaaagttttgtttcgtttcttacgtttgatttcgtaatcatctgtgctcgtgtctacggtaaattagaaaggaacaggatgatctgagccgttgaatttgtcttgcgtcttgtggaaaataaaaactctgggccagaaccaggctcggaaaacactagacgttatatgtagatattggcccaaataaacaaatatgggccaatttagtgttgtgccaataactatggtttatggatgattaatccggtttatggtttgatttcagtttgccttttttgttttttttttagaaactaaaattatataaaaccatttgtaacttggttttcgagtttggtcttaatttagaattaacattatattggatactggatattaatttagagagatttaaatgcaataacaaatcaatttaaccacggtttgggttttaacggttgtggatttttccaccctagggaataaaacaacgggccaaccagtcaaaccaggctattaagaagcagggaatgaacattgaacatagttcttgactaaagagcaaaaccgacgtcgtactacaaatactgagttgccgacgcaaatctagattggcccaaatcaacatatatgggcccatttagtgctctgctccactacgagtacacgtgacgggacaaccctcgttgactctttaacatgttgtacattatctttcgccacgtggacttatccagttgtcaaatctgacggtgtaaaaagacaattcactcgtcaccgcgtaacacacaattgagatctccgtaaatttctggaactatcagcccacattccaaagcaaaaccaaatctacaagtcttgtctatataataaacaccagagaccattaaacacacgaaaattaaaaaaggttaaggaaacgaaaat

SEQ ID NO: 4652 - DNA, 2000 bp, Arabidopsis thaliana
ttgatacgaaaaacacttgataagtggtcaatagataacctaatttgtaaaataaatgagcaagatatccttttttttggccttgatactaagttttttttattttttttttattttgttgaaatcgacgtgttggtaaacgtcttgattagtggatgcaaatctttgttctgttgagtgttgaccacttgacaagcacttgttagtttaaaacttactaacacactcattgtttttttcgggtttctgttgtatttatggtttttgagattactataaatagacaaaagaaaaaataaattcaaatagagaaactagtggttgacaaaaataaaaaataatagtagagaaactagtgaaaaataataactaatgtaaactctaaacgtaaacacaaaaacaaaaacaattaatgtaaatgaagacttgtaaccaatatatctttcttttattttggttcaacttcaataaacaagatgtaaccaatacatctaatatcaaaaacagtagggatatcaaaagcaaacgaaacaatcaggatcatgtaaagcatttcaacaagatgtttactgtagtgtgcttgatttgatgtctgaaaacaaaatcgcattttgtttttttaggatcatgtatgtcaacatacgttgagaaggacgtcaaattggctattcattttaagcaagagacactgatatataaatataaatcaatgtatatatgcaacatcaatttattatcaaaacatattccaattaatatgtaggttggaatgatataaaccatgggagtgaacggaattgagattaaatatagcggaagtctagagcccgacggaattccaattgagatttatccccaacaaagcatgggagtgaacggaatctaatattgacgagtgtttctaattcaacgctatataatatgatatcaaactaatcatatttcttataaatatagtatttaatatattatgataaatttccatggtgacttttcaatgttctgagacatgccttaattaattaccatttaccaactctatatacaatacgttatctcgtaatatgaattaacgataatattagaaattatatgaattaagtttttgaggtccgaatagaagagaagtaggagagataagagatcctttgaggcttgtccacatcttgtatacttcgtagccgcaatatggactgttcatggttcgggaagggttatgataacctaattccaggaggctcatataacataccgttcatgatcttataataatgaacgatataactgaaaaaaagttttatgcatattacatgttttattaacattcgcaaatatatggttatccaagtcgtggatcatgccatgtgggtaaaggcttttagtttggaatggttagcacaattatttatgaatgtatgtatttgcagtaatcatgtataacatgttgatttttttttattattttttttgccatattataaaatgttgattatgcaaatagatacttcaaaatatagataaaatactctgtttatcacctgattatatagattatctataatgttagatgcatgcttatattaactgataaataaatcgagatacatcaaaacataacttataagatatatataaaaaaatttgtactgataaataaaacaatcaagttttaaccatctacagtcttaccatttctttatacgtctaaactaagtataaaatttgaatataattatgtgtgtagagaatctagagatcgatgaattgctaatcttaatttgaagttattgcattataaacgagatccaccacttattattcataacgtatatgaatcgaatcattgatagataaataatttcagccaagaattgaccccacgagtgccaataaataacgacccttagcgagggttaaagccacaacacaaaatttgttcaaagtctaaaaaagattattattacttatcttctcccctgaaataacctcatagtgtcgat

SEQ ID NO: 4653 - DNA, 1838 bp, Arabidopsis thaliana
gagtcattctttaaatcagaatgaattaaaagttggctccggataccagaaaagattataactaattatctggaactctcaagcacttttttttaaaaaaaggccaaatatctgtttacataatcattttcagaattacctactgatgtgattcccaaaattgtaaccaaaattgtaattttcaaaaataataagtttatgatgagttactaaaagggtatctcttaaacagtttaataaacttttataaacttaagcagtcagaaacttaaaatttgtgatattttttgaattttttctgttgtgatatttttgaaacagcatcctacattgactcctagacagatttctaacattcgttttgtacttcttattgcataaaaatacatgtcaacatttctgatataactaaaagtctaaaaccaatatctaatgaataaatcgattcttaattagttatttatatttttttgtcgattgagggggcaatgccccctactatttattcaaaaaacttataaaaaattacaaacgaatattgcgtgggaacgaggttccaacagaatcctctaccataatcgaattgacagaagccggacaatcatccaataactgcaaaccaatcggtaaagtgaacgcatagtttgctaatccgtccgcgaggcgattagcttccctatacacatgtgtaacccggactaaccagtcccttgcgataaagccttggcacaaacgtaccaggaaagccagtggatgcgtatcccttatccctgactgtagaaacccgaccaccaacttcgactcaacctccaacaccacccgccgtacccctctctcccaagcagtcaccagcccataatatactccccacagttcagctaagggagctgaacacactccgatgttaagcgcaaaccctcccagccaactgccctccccatccctaaccacaccccttgccgtcgcgaaccccggatttccgtgtgaggccccgtccgtgttcaccgttgcccatcgttcgctcggcttcttccaaacgatctgcctctccactctttctcccaaattcctgcccgcattgactttcaagtacgccgccccaacctccgcagccatgtcccgtacaaaccgaacccgatccctacatggtctcaactcgccaaacacattcatgcatctccatttccatccccaccatatcgacatagcaaacaacgtaggccaccctcccctactcggatcctctttctggtgtagattctcataaagccattccaagagagatcttgtgaagaacctctcacgttcccgggcaggcactaaccgtaaccaaataccactcattgctggacaatcccgaaggacatgtataattgtctccttcgctcctctacacacttggcaaacgtcggtatcccccatgtgtctccgagctctctccacattcgttaatatagcctggttccctacaagccataaaaaaactcgtaccctttccggagccaatactctccatatcctggaaaagaaacgctccatgtcctgagtctgcgatccctcctccatgagtagagaataagccgaccccactgtaaactctccattctccgtaccagaccatgacagagtatccgctactccgggaccgcctcccaacacgaccgcagtcaatcgtaacagcagcttctccggtaagaaacacgaaattctgcccatgtcccaaccaacacgaaattcttaattagttatttataagattgagatttcaccggggcagaaaaatgattaattgtcatgatttatgaataaaagaaaaaagaaatctacttacacttaaa

SEQ ID NO: 4654 - DNA, 2000 bp, Arabidopsis thaliana
caaatatgttagcgtgatccatgttatgtcatcgaggtgtttcattaccacgaattttcttagaaattgtgaacaacatattgggaccgtgcgattaatttgatttgtgttgacaaggaaaaaattgttttataattttaacataagtttggtttccaacaccggtgtttagtactgttttaatattgtatacctaatgtaagtagtttattaagaatggacaaaatgtacattaactacttaatatttaaatgaacatttgttttaaaacaaatagcagagtgaaaaatttgacatagcaatgtcattttcattgaccaaaattaatatatcaaagtgcgattcaaataatataaacttatagtttaggtttttaacaaaatagtggaaatgtttcgagatgctttcacacaaaacaatactagtattttcttcaaaaactttaatacatatatatatatatatatatatgaatataatgtagttttgaaaataaattccatgaacaaaaaaaggtcctaataataaattcgaataaaatagtgttagttatttaactaacacatgttatgattaacaactttaagttctttgcaaaaaagagtttagtttttaaatcacgagttaaagtaatcgacaccaccaccatcttagattttgtagttaagactaattaaagaaaaaggaagaatacttccaacataatttagagccaatggatttgaagtgagacaaagcatctcagccgttgaaagattttggtctcgatgttttcaaaaaatcttcaaaaagccacaccagagagacactcaaatagagcaccggtccgtcagattcagtttcgaaaaccaggcccaaagccacctgccagacttgtttcccctctaattactatattgtccttctctcttttgcagtgtcttcctcgaatcttaagggtaaaattgggaattaaagtaaatattagtaatgaaccatctgcgtcagtttcgtctttttgctctgtttcctcggcatatgtaagatttttttttctttcaaaaaacactgtttcagatcagtgaccctttctttcattattttggagaaagtattcgaaaataaagtacgtgaaaacgggaaattatttaaactgagaggtgaaattctttttttttattttcccttccgttattgtattattttccaatggtatgttggaagaatttgttttagatttttcgaagataaagaaaaatcaaccaataaaaataaaaatggcaaaaacatgttttagttccttttgaggaaatgttgttatagagggattatccagttatagacatcatcgcaagaccactaaattcgttgtacacaaaaatgataagcaactagtagtactttgttgtttcaaaatttacaagtagatagaattagctcgtacacaaacctctataatagtactatagaagaagcaacttacggccaaaattgaaagagtaagacaaattaagttgtagggggagagtagagtcacgcgctggatttgcgaagagactcgacaatgatggcacaagaacacggtacatatgtagataagtacatctacagacataagccacacatagaggacgagaaaccagaaagaaaaaaaagaaatgaaaattccttattacaaaaaccaaaagatttagagagagagagagagatagagcattgatgaagaccactttttatatattgcacgcatccatataacagctacagagaaagaaaaaagaaagaaagtgattttagagaaagaagaaaaaattaaagaaagttggggcgccaattacaagttttgagctttgcatgtgtttctttcttccgtacattaaccactctgagacataacctctctctctcttcttttgttgtctttctgttctgttcttgagatctctctctctctctctctctagggttatttttttctgggttttttgtttttacagttactctgtgttgttgaggaggcg

SEQ ID NO: 4655 - DNA, 2000 bp, Arabidopsis thaliana
tacagtgacgcaatcttgagtgaaagtgagaaagagttgcagtggagagagagagagagaaggaggacaataaacttaaatgtgtctttttagaaaatctatgacccacaaaagactttttgcagtttttctgtaatgagtttagactttgatgatacacacaaaaccaggttttctcttacaatttctgaagtgaattattggacaatggaatctttgtagatttcacttttaccgcgtgagttaattaattgttattgttctaaactttaaatattagtacagttatgatttaggaaatttacatgtttgttttaatcacacaaagaaaataattgaacttttaatgttttacggtattaacatatgttattattaactttttaggtaattatagttatgcaatggaacagatacaagaaagaagacaaacaaaattgaaaagaaaaacaaggataaaataaaaatattaatgtacagcagattctcctatatagacatttatgtgttttttttcaggtttaggacacgtaatccttttatgtgtgatattagaatagatgtattttataacataaatgtataagaaaattattagattatgtgtattagaaatttagatttgttgtcttaaatgtgtatatattatctaactagattaaagtatatgtagtggtaaataagggttacattttttgtttcaaaaaaatgtctaaaaatagaaacaaataataattcactcaatattatatttatataatatggttatatctctcatacaactaaaataaattttaatgaattttagtttgttagattcagttcagtttggttatataaaaactgttttagttatttatttattttgtattttaagattatgaaaccaaaaatttttattagaaattttgtgtaagttctatatgtcagttttgttctgtagtgggtgagtaaaataaccgaaaaccgaaccaaaccaaaccgaaataaattgtttggtttatttatggtttagcaaatcatatgctcaatcattttcatgttcattgaggtagcagcaacttcctggttaaaccaaaacaatgaagatcaatttgaagatcacaagtggaaaccgagtacaatgtaagtcgatactattaacttggtatagaaactaaagaaatattaaactgaaaagacatgtgcattgcgtttaactaagcatgccaccttattttgatgcgtgagacaattgttgtactagtcttaaatactcgattgatatgagttatctactaaattcacaacttttgattaatcttacaagtggcttgtatcacataagccatgaaagtaactaacaattaaatcaatacgagttacactaagcagaaaacattaatggagaacatctattcacaacagcttcctagagatttaaccatacattttgactcttgtaattttccttacaaacgatcaattacctctttaagaagtatgaaatgattattttttttataatccttgatttatcttcattgttaagatgagctttcttttccttgggcttttattacccaaaatccgatggtcggatccaacaccaaacatttggttcgtagtagccgaattagccatcttttgtccagaacccaaacccctttcgtgcttatgaaatattccccgacaagaacaaagtgagaaaacaaataaaaacaagtagaatcatattgaacaacaaaagcaatactattataacatcaaatcataggaaaactgaattgataactcatacatgtatagaaaatgaaacgaagaccagaacgttgtgggaccagccactttctgacaactactcctcatttcaaaataacacaataagcgacgacttttcatacaacttgaaactgtcttatgccttcttccttgtcacaaacatcaaaaatatataatatatacacattagcaaatgcatatgcacatgaatgaatttttgatacagaaaaagagagaaa

SEQ ID NO: 4656 - DNA, 2000 bp, Arabidopsis thaliana
cgcgacctattgatagccaatattaccatttaggaatgaaaatgaatcgaaagtactcgtttatatgcgaaactactactactattcaaagaaactctacgttactttttcttgacacacgacaataattggtgatgaataaagctagaaaagctgatagagagaaaatacataagtagagagtaatcaaagaaaggacaattgacgaaacaagaacagacaatgtggggaaaatgggatagagtgtaatggaccagccccctattaatgttcgaccccattcttattattttccttcttatccccgactttcatttttcttcttgtctatctatgttcatatcgtgcgctaacacccaaattaatcttcttcccttgaaacatgttttaaataacggcacaaatagtaagcgtagattcataaataaccccaaagtaaaacaacagaaagcatcattaattatccggtggagacgagatgacttgtgtgaggctggaagtccgcgagacatacctttacgtcggtgcatcgcagaatagacgtgtcaacgttttaatataatatgttgaataatcgaagagtaagacccaaggatagttaatgccaatgtatatccatgagaacttcttctagaagactataataaagtagaaacctttataaagttataatcaatcataatattattgatgaatcttatattcaaacgaaactgccctcgcaattttctacgtaaaataatacgtattacaaaattaaaaacacatgatgatatcttacaacttataacaactaagcacaaattttttggcaaaacataaagaatctatacatatggactattcgtgaaagaatttgtttgatagtgcgtgcacatgccaatatgaaatgaaaatgtccatcatacatattaatatacctgttttaaattgtagtaaattagggagaaacagttcacgagatgtttacttatcggttgacggttgcgtcagtgaatacgactcattccttattactccatattatttgtctttgcatagcttctagaagctttttgttatttcaaataaaaagtgatggtaaagactaaaaagctcactactggtcttcgtgaactttattatcaagatgtcatagattcggtttcaattgacactgaaatggaatagtaatctagatatctagttgataaactagtttaaaaagttattagttcaaactgtttttaaactatagacgctatacagtggtaaaagcgttaaacaaaaagtgcggcgcagtatactgtcaatttaatttgtgattataatatacaatattgttacctaacttcacttaaccaagtaaccactgacctaacttcaactatttgcctttacaatttacatcatgaaacaacatggacatttcttgaatttttggttgatattcaaataatcaaattcttatggagtatatgatttactccactgttagttgttcattttgtccttatgaaagtcttctagaagctttctacttttcctgttttatgaaaagattgttttaacaaaagcaccgtcttcatgaactaaaccagttgttatagattccatttcaaagttttattccttattaaggaaatcgcatcaaagtaacccatgtgttgactcttgcctgtttggtgagattgaaagggaatgattaagaaataaatttttagatacgtttgcgttttgcaacatacacgaatcttgatttttttcatacgctgctaaatcaagtttataggggtttttaaaaatttaaacgaaccgtcgcgttatttcaaccgcaagcaaactcatcctcctctttccctatttaaaggctctgccacctctttgtagcttcacactcactcaaatttaaatcgcaactttcgtcagtttttgtgtgttttcttctacacatagacactttgctcaatcaaacacactctctgttctgtttttctcaaacttgtttaagttcgatgact

SEQ ID NO: 4657 - DNA, 2000 bp, Arabidopsis thaliana
cttccggcgtgatagtcggtgagatcgagcggcgatagcaaggcgtcgtctctcgttgttgatggatggcaaaactgtaaattgagaaggtgagattgagatagagaaaagagagcgactcgccattttaatattcgttcttttttttttctttcttttctttaaataaacaacactccgtctcttgcgctacgtagataaattaatttttcttcgtcttttttttcgattgataaattaatttttgatttttctcatgaactatattagcagcttattaaatttttattgacaaaatatgtattgaaccttatattttaaataattttgagttttaatgtctttttatgtgatttattgtaaaaaaaaaaaatcaaattccagtaaaaatatgagatttgaatttttatatatgtaactaaataaatctttttaaattttctcaaatcctttaaaattaataaagaggtgtattagatctaagtgtgtcaaaatgggtaacacaactcaactcaactcataatcaaatgagtttagggttaaatgagttatgggttgatccaactcattttgttaaatgggttaagtcaacccataactcatttaatttaatgggttgagttgttaaatgggttaacccatttaagtaataatttaattaattattattataaaataataataaataattatcattattaattcattatcatcaaaacttaatatatttacggattccactttttacgggtttacgtttttggcgggaaaatctcgggtttacgtttttggcgggaaaatcatggatttacgtttttggcgggaaaatcacggatttacgtttttggcggaaaaattacgggtttactttttctcaatttcatcgcttgtatatttaagaaatttggaaaaatattaattttattaaattggtttagatgtgttggttagacttaaattggcattggtttagagattttagttggtttaattcaattttacaaaatttgatgggttaattggataaaccattgaaaccattaaccattacaacccaactcattttactcatcaaaccaattgactcatcaactcatttgactcatcaactcatttgagtcaaaattttcaactcattagggttcatggattgagttgagttgagttgagttgactcattaatttggaccttacaatttgagttttagctagtttttatatgagtttgatgattttaggaaaattgatgtgatttattataaaatattttaaaattctatataagaccatgaatttcgattttgttatttttaactaaagaactttctcaaatccttcaaaattaataagaatcaaatctaccaattattttcaataacaatagattttaagatagaattttaaatctttagttcaataatactagatttcattaaagtttttcaaatccataatcgaacaacatagaatttataaattttacacaaatcacttaaaatattagattgaatacattcttataaaaatcaaatccataaattatttttaataacagtgaatttaaaggtagatttttaaattattattttaataacactagatttcattagaattttcaaaatccataattaaataacatatacttgtaaaatttacgaaagtcactttaaatactagattgaatatacctcttttaaatcaaaaacgatgaatggatggtaaatatacggttcacccatacccattataaaccgtctttttcacaccttccattcaacaagaactaattgttgcgtatttgaccgatcgaagcaagaaggaacgttctgtttattttcttttttgttaaaaaaaaatcagtatttaaatcgtgatttgtagaagaagtattatcataatgcctctacacaaatctgtaagaattgagagagataatttattttaaagaatcccaaagaagcttcaaagactcaaaaaggaaagtaaccaagaaaaagtca

SEQ ID NO: 4658 - DNA, 365 bp, Arabidopsis thaliana
attttaagtagtaatttgtagtactataattagttctttagtttatgtactcttcgtgtcgtttttgtctatatagatacttgaacgttgtgccgtctctgtttatcgaatgcgcattgtgtgtcgtttgaagctaatcgtcgacattaatagcgtttcaaacactaaactcaaaataaagataaaatcatatataataaaataatgaattttaaatgaaaaccactcaaaatggtttttatctatcttccgacaaaattccgtgcttcattgctcttctccacaagacaacatttctctggctcagaatcgacgccatggaaatgtaaagaagaaacaaagacgagctctcaaatccagcagca

SEQ ID NO: 4659 - DNA, 2000 bp, Arabidopsis thaliana
gcttttgactttgttcttcttctataagaataaagacattttctttatttattttttctgactaatctgagtctttaagaccacaaattatagaaatttccaacaaattcttatatacgtaccagatatgtctttttaaagaatgaacaagtgaagctcatgagagtcgtctcgtcaatgtataatgttaatgtgctaaagttgatatcacgaaaatactaaaatgcaaaagaaacgtcgcggaaaccaatctgattaattatttcacctgtcttttatatttttgaatcttttatatatatataagaattggtattgtttttttgcattttgtaaacgacgacgactcgtacaaatcagtaatcgtaataaacggtgtgaccgtgtgagtcaacagttgacatcttagatcttgtgtgctgagtgcgagtggtacatgtatgcgttgtgaactttttaaaatgttatatgacaggtgaaattcaagaatcatttttttggtatgctggtacatttattcagttggatgttttgcaacttgaagaaagtatatatgggcttgtaaaaactatgtttttgatgtgctacttaagcgtcgttcgaccatagcagacttattttgctattatcgtggcattataaagacgtaaactgttaaaatatcatcttcataagaaaaataattaaatcattgtaatatatagaaaactattgtgtgcactacatttatctagttttacttgtcgattaaactagaaatccattttattgaaaacatttttcttgtatgcagttgagagtggtgaaacaacttgtaaaaaaaactatttcaacagtctttatgattactttgaatggcgttcatcttcactctataactgtataatcatattaacgcgttgaaaaaaactcatttaacacagttagttcttttgggcttacctggaattttgaatatatatatatatattcgtgttatttaaacaagcaaacaaaaataaacaatattcaaaattttcttttacttttctccataaaaaggatgaaaatatcattgtcataaaaggataaaatatacatataaacgcatttttgttgtctttaaaataaagttataatcaattttgacatttgttttgtttgacccttcacataagccaattcattgcatataatttgaagttttgaactcctaaacatagttattaattttggtttgtattaaaaattatagctcaaacttgtacttacttaacaccatgtaaaacttagagtaagcgtcttatctaaatgaaaaaaaaaatagaatacgcaaatcaccttcatatattgtttaaaatatttgttaaagccactatgagtatgatatacagaaagatataggagggtacaaaagaaagaccgaagctgaaaacgaccgattctatttctctaactcttttggtcccactgagagcaacaagcgtttaagtaagtaaacatcagccgttggatattgaccttcctcatttttctttttctttttggggctaatttgcatgtctcaccgcgtagaaaggatgtatctaaaagttgaagatattcttattggatcaatcaatattgcaaaggagattgtctgaatattggatatacgcaataaaaaaaaatttctttcgcttgttacagagtacatacatactatccacatgttatccattcgattttgtataagtctgacataattcatctttaacaaaaaaaaaaaaaatctgtgacataattcaataatctaatttgttttatgataatctctcactcgttagctgaataaaagttccgtacgagtaagctgtgacacgtgtccctttcaatctccgctcaacgcggtttccatcgcttctcgccgtccttatataaacttcctcggccccatttttcatttctcacctctctctttctttctctaacttcttcttcttctcctttcagaaacccagcgaccatcttcttcaccggtt

SEQ ID NO: 4660 - DNA, 2000 bp, Arabidopsis thaliana
aaaataagatttattgaagccctctctaagtcatggtccactcaacaacaattgtgatattgatgttttgattttattaaaatctgtaacaaaataaatatttctatctaaaatgaaaatactaatgttgttttcctaaaattgttgtagcattacttttcaaatgattccattttcttacaagtgttacaaaagctttttgcgaaaaaagtctcgtccgtgttattggcggggcctagtaagcttgattgtaccactaatacggcgttgtttcgtggggcctgaaagcttcccactcaagggacgcctagttgggtcagcaccaccagtttaacgctaaggaaataaaggaacagcctggcgtgggtcatacttgtgtctatctaatctttaccgttcaattccatcgtcttgtcctaaccgttgattctatttcgttcgttgtttaattagtactagtagtagtagatattttcttcttgtctacggtctcaacgccagacaggatttactataagataactttgtttatgtttgatttataattcaagtgtggttggttaaagttaaaccatggttctccgtttcacaccgttgattatatatttttttaagatatgtaggaagtaaaactttaaaaggttaaacacaaggtaaaatgtattattggaggcctaaaccaacttggtggccgtggatggggaaaaaaggtccagaagtgttggctataggattcctcgtggacttagagaaatgacttgtcgttctcttcttttatttcagtggacctcattaatttttatatatagttggcctataaatttataaatgttcctttatttttcttaaaaaacaaaaaggttttaaatcaaacagcgggaaaccagcccaatgcttttttaatttcttgattaagcccaaaaaagggaaaaagttgtatgggcttacataacatttaggactaaggcccattattttgcgaacaacacaaaattgcttacataacaattgctacgattcatgttgcagaagaacaccgtttttgtttttgtttcttagccttaatttaattgtttgtattcaattgtttttatcatttagaattttgcttcgtccttgtcgaaatcctctcttatgttcttgggttcttatgtacttattcttttctttcttgttcgttcttttttcaagttatgtgaagtaatatttgtcaatgatttcaaagtaagttgttaaaggctcaagaaaccaaatcgttatctattatgtcactaataaaattctactaaatatatataattcttctcctttttttacttgccgataattgtatcctatttacaatgaaataacgcaaaagacttggcgtattatcttttgacacacgtttcaagtcaacgatttcgacatctgctttattctattggtatgtcgaccaagatgtcaatgaaggggtggacaacgatttactgttttcaaatatctggattattaacctctggatgttatctatattttagaaaatctggatacctccacaagaacaacatccatgttccgaactaaaaaatggaatcatataatttctgtttttagtaaattaataactttacatagttaagtttttttaaagtatgttatgacaaggccatgccgaatccatgtgcaatcataatccttatacaaattacctgtccgcgttgacgaaacctttatcgtgccctcttgtcatttgtatactctagtaaacagttgttctcgttatgttaattaacttctataatgtttcatattctaacagaataaacaaaactccaacatgtaatgaataataaatactaatactattttattttattttttaacagtaagaaagaaaaagaaaggagattggaaagaaacaaataacattccaccacaagcgtgtaccaatctctcccgctctgtctctctctctctctttcctccatctctctgtgttcttcttacagacaccgaga

SEQ ID NO: 4661 - DNA, 2000 bp, Arabidopsis thaliana
tatatgagctcaaactaattgaccagtctatatatgacctcttttcttgttttaaaaattccagcatgtatatgatttttgtaaggagaagtatatgattattgatgggcactcaaaatctgaggaagtttgagatacacaagtggtgggagcgaaaataaactgaagtacaatttttctgcaccttctttgggaaacatagataattatacttgttttttattttgaaatagttatactttttgacgacataaattattctttgcatgatttaaaatttcaacctacatttatgcttgcaatttcgtaattacttccgcctttattgctcatctttaattctgccttttcttgtccttatagacataaacatttgtgtgtttgtgtgtgacagcagtatttccctatctgaaaaacaagaatattttgatttattagtagtttgaattatgaattgcaattaagttatgattaggtagtgataattatttctcatggggtagtccttttcttcaaatctcttgtggcgatggttcgtgtattaaatcgtcatgtgccataataccattaacctagctgtaataatttaatgtaccgttaaaaaggttacagttgctctgtctatatgttattactcttagccccgtattagctctcaaagcgtacgaccacgcaaaagcctgcaatgccactaattaagtttcattccacatgccatatatcttcttttgtcacgattatatttcccataattgagatttcacatgcactctatagttttatgtcgtcatgatatacatacattgggaaattatacgaccaatacgagtaaacgaaataaaaaatgaatggtcaattatatgacacaattcaaattctaaacggaactaaattttagcctctatggttatgtatactattattacagtcgataagtgtgaagcgagtcgacgcggtatatcatacaccgatcgagccacaacacgcgacctctcattatattaaaatcacatttttatgccacaaatcaaagtcgttgttgttaatttggtttaattgaactttgtattataactcggtttagtcttcaaatacagctgtcttcctattgatcgctttgttatcttatgtcagccattttaagacatttgactttactctcataatcatccttttctgtacatttatttgattcttacggttctaattacctttctatatatatgatatgtttttgtcaaaagcatcaagtgtttttgtagtttatatttgtagtttctaagtttatgactttggaaaaattaggaacgttctggcaccacattgtaatatgcatgatcggaaattttgtggtcctcttgccataattttcgcgcaccaacaagtgtttttatagatttcgtgtaatcgtttatttttgaaatattttatagctttctgttgactgtatatttgtgatttatacgcaattctttaacatatacagaaacagaatgtcggtaaataaaaaagaaattatataatcgaaaatgattgtggtagatgtcatcgtgattaacatagcttaactagcatcgaatagcagcatgtaatttaaaaatgtttcattgaaatatatgtgtgattttcaatcagaattagtttggctttatttcaatctggtggttggagattagttttctcacacagtggaaatttcctgatctattatcttgtttattataaaactaagaaaaccaataattgccagctaatagcaaaattaaaaaaaaactataggaaaaaaataacgaagatatagaattagtccctaaagaacaaagcccacctccaacgactacttttttcactataaaaacaactcttttccatgcagaaacacaatcaatcacttcttcttcatctttcctcaaaaataaaaacattttctccaatttgttcttctttaataatttggagaaaaaaagtcttagctaagactgaacattatccggtgaaga

SEQ ID NO: 4662 - DNA, 2000 bp, Arabidopsis thaliana
aaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctccattttttccccaaataacacaaaagaagaagttgaaa

SEQ ID NO: 4663 - DNA, 2000 bp, Arabidopsis thaliana
atatataacatgcaacacgttaaagcatgtaaacaaaatgtgtgcgtacgatctacgtgaatttattagcttataattatcatttgaacttaaaatatatgtgaaattattaacttaatgcaagtgccaaactgtcaatcgcaattccactatagaaaaatttgttattcaataggtatagtgtggaacatttttaccaatttgtaatttagtaatactgccggaaagaaaaaatccttctgtttcattttaattagtaagtttcattttagatataattaaacaaatctatctaaaatattatttacatcattatcgttctaaattgacaatagaacttgcttcatatgataacttctcttgcttatatttataatctcttgaccgaccaccattacgtatgttgacttacgaccccaccgtccttcaccaaccgttgcaatagatttgactttcataattataaaaatgaattaatttagatttcataattaaaccattaacatagttcaattgaattaatttagaattctcgaccgaattttggcgtataaaacctttgttaattttacgcttataatttcctgtgaacactatatatagctggattccgtaatttccgtgagtctctacataaagacaaaaacattttcatatggcaatccaacggctgtgattaaactcacagctgtttttttttgttcagatgacgtggagcctaacacttaccagatagaaaactcgagaatccagaccactgaacctaaagcgatcgctgagtaactgccacgtgtaaaacaaaatctaataaactatcgttttgaataatacagccacagaaactatgatgtcatcttcacgccacgtggtttatgttctatggaagtattttattttgaaattcatacgtaaatctacgatctagattcgtctcgagaccaacaacttgacccactcacttagctattggtgctaattgtctttccctattagattaatgaaagtttagaattcatcattgaaaagcgtttataatgcaaggtacaattcgaaagatattttagaaacattgtatttgaaacaatgtcgatcgtatggtccactacaattatttgaaatgattcaacatcaattcatttatttgatcgttttattgcgttattgtttgacattagcggttctaaaatgaattatagcaaaacaaagttacgatagtgacttatattatgtttttgtttttgagtatttgtaacaaacaagtggtatataattggtgcataagaggcatgacaaatactgacatacggttggttcgaaaaaacccaaaatacacgcagcaaataacaaggaatttaaatacaagttgaaataattaacattgagagatgattaaacttgtattatcttcacgtgaatgatgatcttacttgaatatgtaagtccaaataaaaaatttataatagcaagttgtaattgtttcaacttatttaaatttttgaaacaaattatatatatcgtcgggagaaatgataagtaatcattgcaacccattttgttagtcaatacagtacttaagaatatcattaaacacaaaatcctgcattaaatttataaagttactattttctataaccattaacaaaaaaaaaagttattttctataaacacacaaaattcataaaagcatattcccaaatatatacggcgacgattattataaacagaggccaaatgctatttttagtgatgaatctctaaaaacagtagagagagaaaccttcttcttctttcttcttcttctacaaaatttcacaaaacgagagagaggagagattcaaacaaacgaatcaacaggtgagaaattcgaaatctttgcgagctcgtctcgcccagaatctcgatttctccacctttcctcttcaattcatcttccaaatccctaaaaaaaagactcaaactttttaattttggtccaaaaaagactcaaactttcttcatca

SEQ ID NO: 4664 - DNA, 533 bp, Arabidopsis thaliana
ttttatagtatatttttgggaagaaaaaatatgggagaagttacagaaaaaaatgaagatgaagagttaacgacgtcggtgtgtttgttttatgaagctaaaatgcttagctcacttggctccatttttccacacgggtgttaatgctcatacgtgacatgcttttgagaaaaagctgaaaacaacttatattaattcattattgatttacatattaaaattttgaaattttagcacaaattacataacatattattctttaaaagttttccaaataaacaatattaaagaatactaattcaaatatttttcgtatataatatcatgactactttctattaacaatttatagtcaaattatatagcgttataaacttataatatgaagacttacgtacttttctaatcaaagagagtatattaatataatattatcaggcactagcattagtcagtggctactgagtaaagctttgggccaccgagagaaaccattttctgagagcacactttcgttgacttctctttaacca

SEQ ID NO: 4665 - DNA, 2000 bp, Arabidopsis thaliana
tttttggtcaaaacatcttcagaatttttaaaatacccaagatatttctatgtaactaattaatgttcaagaggttttaatgtaattaatcaaacccgagtatgaatgaaaataacaatgtctacaacttttagtcaatcttgagcagctatcatcagtttgttattaattactataatatatataaaactaactttggaatgaggtagctaacatgtgaaaattcatataaagctacaacttgttctattttatagtgacttctatcagatattcatattcgcttggggaggctctcggcaacaacatttttattatcattttcctttgaattctcaaattcaacatacgactgatataactgtataagataagatatttagaccctgctttgttaacttctacacgtttaaaaaaaaaaaaattaatggtgaactatgttacatcacaatagacgtgtactgcacaattttttatttcttttgaatgaaatttttaaacatgcttgacacaatcagacatgaaagacaaagctatttgtataagagtaaaataatgaacaaataatttatagatgtaaggaaaattatcaatgaacattaattcttgcaagtttttcgacaaaagatatgcttgaataactattacagtctgttaagtttatagtagtatatggataaattcttaacgaagaagtaatgatgatattaagaagagtttggatggtccagaagcataatgaatgattggatttaaacgcacatggagagttggtgatgacattctgaagtgcaaaccaaatagaatgagctgaaaagatttcgaatatttggatccgatcggctaaagcagtgtagacgcttgaccaaggatagaaaaagaataatattggggaagtttttgaaactttacatataaagtaaaattgagatatgtccagtgaggaagatgaagaactataatttcaagcaacaaggaagaataaatgtttatcaaaaaaagaaaaacaaaaaacaaggaagaataaaggcggtatgtattttacttaggactaatgaactaagcatattgtgttatatgcatgatttttttttttttttaccgtgaataaaaaaagttagtggtgtgaccaaggtggctaagtcagtcattttaacctaattttttacgatcgaaaaatatcacagaagcgctcagatcgcagtggagagttcgttagtttttttttaatcaaatctgttcatcatctatttgagactggttttatggactttttaatttccgatcgaagcaagttccattatttcgtttgctatatatggccttcactgaatatccaaatttttgtatcatcaattggatattcttatacgtaaagattaatttgttagtatacttgaaattttcctaatattaaatttctatagattttttcgagttatatataatcttattaatatgttttgatgtgctggtaaacttgtacgttagtttttttttttttttcaatttacgttgcgaccaattatttgttagtgtacgttgatcattttttcagtttgtgtttagttgaagatctaaaaaggattataaagatattgtaaaattaaaaaaacatctgtaagttaaaaaaacatatacagttgtaaagtgccctaacaactaacaactctttcacgttatttacttttcgtggaacgtgactatatgacacgaatcttgtagactcaatttttctaacgttaatgactaattaaaacacgcactacataaaaatctagaagcgccatcttttctcactttttgacttggtaaaacaacacgcaccttgactagtaattattagcttaagttaaaatctgttacattcctgatcaggtaagatttattcagcttttatcctctatataatgactaattagattaatcataagttcagaatcaatcagtaaaacgaaaagctaatccaaaactctttaattatttgcaacaactgatca

SEQ ID NO: 4666 - DNA, 1428 bp, Arabidopsis thaliana
gcctcttagagaaaatgatagttaaaagtcccgtttacttagaaatacgtctgtatctcaaatacgcaagaagccaaagccatactgcaaaaccacaaactctcaagatgctttatcagaccaagaatgtcctctctgtgtgattacatgagactattgtgttcttctttatcgtgttttgagaattttcctgtaataacaggtccaaaggattcgaaggtgctgtttcttctatctcctatcttgttcatcgttcctttttggctctgatcatttcttgtgccaagatctattgacgatattaccctccgctctgttattcccttagataaatcatatgtgttgtaaattaggcccaatgacatgctcatgaaaatggaaaactaaacagagcttctgtcacttgacgtttcaggttttcaaaagagaaacattaatacagagcggagggtaattttgtgtcgattcatatttttcacagagcaaaaagtttccttcagcaagaatcaattcatatcagaaatacagataataatgagaaaacaccatttttgaagaagccgatacataaagttgaataaatcaattcgatttcatttgtcaagaaccggaactggacccatatcaaaccggttttattgatcttcctttgtctttccgagagcatggggagtgcagaaaatgatgacatggacatagagtgagcaaaggagataatatctactacatagcaatgtgtaggatgacttacatttagggtcaagatgaggaagatttcaagccagagagatggcttaaggatggcgtgttccaaccttaagaaatacatttctaataaaacctgagatgttttctttctttgactatgtatgtaggctggtccaagaatctgtcttggcaaagatttcgcataccggcaaatgaagacacttattcacttctttcgcttcaaaatggctgatgagaagactactgtatgttactagagaatgcttactcttcgtgtccaaggaggacaaacacctctaaaaaacttttttttcatatcaaataatatatggaagtataatcaattaaaaaaaacacatttttcccccatatcttctgttttgtctttatataatttgattacgtggtacaaaagaaagttgaggccctaattcatattgtgcgactttttcacccacaattactacatgagaaaacatcaaaacgacaaaatcggttacactcaacgttaaccttcgaggtaaaagagagggttcagaatgtttcgttggatgcgtgtaaaatccgtcttgacttttcgtgattgttgaatcgtctatatatgacttcttagcgggaagattgaaaaaatcagacaacaagacgaaacaacttccaagccaaaaaaaaaaaagtgaatcaatggagattttgacgagc

SEQ ID NO: 4667 - DNA, 2000 bp, Arabidopsis thaliana
caaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatgcccagtcgtcggagacatagctacaccgtcggatctcctgcaaccacatcttccaattacagtaacactactttcaccgatcgttccttcccgacaacccctgcccgtacatccaccgacacaaccacctccatcgctcgtcgcatctccggtatcttcatcaactgcttcactcctcccgattccgtttcctccaactacatcgacaattcaaagtcctcttccggtatagtttgatcagtaattcttagattttagacttttagtggaaacagttgatg

SEQ ID NO: 4668 - DNA, 2000 bp, Arabidopsis thaliana
tcttgagtatcttcacgtttaatttactattattttctaatgaaaaattgtacacctttttatatatatgaactctttgttttttcgttagttgctcgtgtagtaaattaaacatatatgctcataatcaataaaaacatacaatgttagaagaaaaaaatacaattttttttactaacgaatcatatgaatagttgttttatatacggtacattaacgatcctctcatcagctttatagataacgaagcatattattctccttagttccgctttttatcacttgagattaaactctactcacaggtttaagcacgtaaattagttactaaataatggatttgacatttacgctttgcatgcttatatatgttacccataattatttccctttagttacttaaagttaccaaaatcaactacttcaagattctccaatcaaaagaagcgtgtaaaagcctctatagttatatagtagtatatagaccttgaagatttctttttgaagaaaatatgattatactgagttcaaaaggtcgaaaagaaataataaaggtagaatccctttacatgatgtgtggaacaacttttcttgacctccaacttcttgggatcgtgggaaatatataggagaatctaatcggaagttgtacagaacgtgtaagaactaagaaccatattcactttgttgtcattgttataagattcaagattctttgaccggcgcgtgaaaaaagcatccacctataggctcaagattcgtgtccaagaaaatatcgagaaccgatgattacttggaaagtggaccattttttaaaaaatcaaaaattaaaaaaggaacgtagctcatgcgaatagtttagtccaccaaagtgaaatggtagaacatttggtttcagtttagttgtgtgtatttttattaaaggcttcagaatcaatttcgatttttgaaaaatgagtttttatagccatgttagtatgttacgaggatggaaaagcaacctagctagattatcttgtgatatgtgttattgttcaagagaagtaggggcagtagttgtcgagatcatgttattagtgtcgctggaatgttagatattgcccatcctgtctctttttccccatcgtgccctaaaagtcaaactatgcatggtattagctaatcttgaataggtttaattcagtacggaaactctaattgaaaactaccttcatggagtaatagttatcgaggaacgatgatgaggtattagtggagataagcagatttggactcaatatcaaaaattaatggtgggatccatttccgtttcacctaatatacatagtggcaaacaaaaaacaaatataagaagaaaagattcagtatcgagcattctagctatgtcggtaacgtgacaaagtcctttttttcgtttgtctgtttctttaaagttaatcaaatcggccaacgctgcctcaacaacgagcttcctttttctaacgtccctaatttgccacgtccattttctggactagtcccggtttaaaaaatcttcagagatgtattcgtggtcaacttcattaactctttctcttgagcccttcattagttatgatcttatttactttttaaaaatctaaccaagtactgtatattatatatgtggtagccaaaatattatgttaaattctaggctaatccgatatatcaagaaaaatcaatatataaaaatggagagctatttttcacgagttaagtgagagagatgagtaaagaaaggcacgggaaggtgaagagagtgtaggtttccagcttcttccccaagaaataaaatgtatttgactttgtctaagcaaatatgtcgtcactttaacgtcattcattacctagaatgcaattaagatatggcttttacataagccaccaaatttggttttgttgccccaaaatatcccaagaaaagatcaacttcttcttcttaccaaaactgtcggcgtcgtctcctctaagctcctccc

SEQ ID NO: 4669 - DNA, 2000 bp, Arabidopsis thaliana
aagagtgtttctcttatctagacttgcaaaatcaatcaaatcttgaggagaacagagtgtatcatcacgtccatcaagaagccttataactcgtatgagttcactcacaacaatggccaccacacatcttacaaaacacacataagaaaaaacaaaaggagttaaaaaagtgaagaaaatatttcaatatcatatcttatctatattacaattagagtagttgtattgtaaacttttcaatattgttttaaagattctcatatgtacttcatatatatgtctctttatattgcagcatataataatcttttctctacaaaatattcattcatatgtccattcctttttctcttgcaacttaactgtgttctttctgatctcttaaagctttcattattatccttcaatcagctttcagtaaatctgggattttgaaataaaactacaagaacaataataaattgttagaccaaacttgtttcatagagaaaaaaaaaagaatctgatacacttacctaacatgttgaccaagatgcaaatgtagattatttaatcgtcctcccagctctcaaaaaaaaacccatatctttagcaatttctttcaaaacatggagaatattttttcgagcatcacttataccaaccagtgattcaagaagctggtgtagttcaaaaagtatagccctcactcgtcgacgaactttaaatgaaagtaatgaaaatctggtattaacttgaaactttcacacttctcttccacttttatcctttcacactagaaaattacaatgtgcacaattatagccgtttcacacttctcttctacaattttttttttcacatcaaaaaattatttcaggtttttgacacatattcccaacaatttatttttcttaataattaatataatttttaaaatatatcaatgtacaaaacataggctccaaatggatgacaaataattgaatatttgggtgcaaatggttgcacaatttaaaaggttgaagaggttaaaaacattattcaattaatcttcagcattttagttgaaaaagttgaaaaaattattcaattcattcaacttaaaaagttgaaaaatgaacaaattataaaggaaaagtgttcaacttcttgatccacatttttggagatgatcattcaaccccaattttgttcaacctaataatttcaactcattcaattttgaaaaaccatttgtacaagttgaagatctttcaacttattcctctacaaaaaggttaaacaatttttctttataacttttttggttgaatggatgaaattagttcttagttatttatctcaaatagtaaaaacataagatgaatgatcatttaactttttataacctcttattttcaaacaacatttgcacccatagtctaaaaatagaaatttgttgaccaagaagaatttggtatcaaatgaatattttttgtggctcaaacttttattctctctttaagtagctgaaaaattaacgttggaaagtggggtctacagacctttacgcccatttatttacgctacaatggttttctaatcacatccttaatcttacaatttgtttgataataaatctactaattaaatttgacgtcacaaatcacaatgcactgacgcccattagcatgttagtgacaatgtaaccaaactgattcatcacatttcaaactgaactcattccggttgactaatcggttgggttttaactcgccaactattcttatcaggccaggcccaaacattccttcacaaagccctgccaatttgattaatttttgtggcacgtgattttagttttgtgttaggtctcaccaagattattgatcacgttccataattcaaaactttgcattatataccaaaaatccaatccgtattgaaacttcatttgtaaagtttttttttttcccaaatagtactttttttttgtttggccttcttatagaaagaagaactcaaagcacagagagaag

SEQ ID NO: 4670 - DNA, 2000 bp, Arabidopsis thaliana
cacaggcatttcaaagaactccagtctctagctatttgacatcatagattcagctttcacttaagtttgaagctgctagagatattagccatgtagtaatcaaccatatctaaagaaactatattctcaaaccttttttctaaagaaggccgagtaataaactaacaaacgacagtcacaagacaagacatatagtcacagaactctagctctttcacaatcatagattcagctttcacacttgtttgaatctgttagagatatttgccatgtagtattcaaccatatctaaagacactgattctcaaaccaaactacctactagaaagggaaccatatgttctttcggcagttgattctattgcaaaccaacacaacaaaacaaaaaacgtctttgcatatgaaagaaggtgataaaaattgtctaaaacatacagctggtgatgtaactgaggacaatgagaagactctgtcttcaggctgaaacttccttgaccttttagcactgcagaaatgggttcataacttcatatcaaactcaatttctcgttccacacaacaaaatactaaaactgagaagttaccacattctctaaagtgtatgaagctgcaaatagaatccaaagtcaatgttttttcagaatcaagagaagaggagaatgagagacctagcagtactcttggaggaagacaaaaacccttcaaagcctttcaaagcatttccaatatgactcgattcttgaagatagcttgtctccaattcataaacctaagattacaaagaacccaagatttgaagtatgccccaaacaataatttctctatgaaatcgaatttcacaattgaatcgactctggaccattggtgccctaacctgtttctcgatgcttcgtaactcttggcgaagcttctctcgcttgttcagaagagaagtgagcatcgcaccaggatccgtcgaactcttttgccctaacgacattttctgagaaagaaatccacaaattgcgcagctttttcccttcccagaaatgggtggtcgctgaaattcgacgcggaggtaaccgttgcctgatttgagtcgattacgatggagacgatgattctggaattcgatttgggggttttcaccaatggtccggtttgatgtcaacaaaaataaaaatggtccggttctcttttctttttataacttttttttatgggtcagagattttattaactcaactagcaaattgaccaaatagtctacggccaaatgtggctacctgctttgctaaagaaagaatcagccaaagagttggcattgcatggaataaacacaagtaaagtgagaagcatggaaaaagaatattgaaaaatattctacctcttgtaagaatattgaaaaatatggtggtatttgcgatcccattgaatctaatgtttaatataaaatgtagtgatgtgcaacaaaataggtaaaataagaaatgctttgttaaaagtcattgatataaaaaagtttgatgtccatggaaaaaaaaataagtttccagtataacgcttgattggttcgatacttcaatttgaagctgttgaattattttacagtagaacgtgcataaggtccaaccaattactcagcaaactataataaacgagtgatgaacttagatttctggtagcctaaaatcactagcttctttataaagtttccactatgtcacatattctcggtgttttatgttaggaataggagcatctccgctgaaaccccgccgcaactttctcccaacaaaatagacatttagactttattaagagacgacgacttcaaagtctttaattataacttaatgacttaataactcgggtcattttttaatctttgtcttgaatttttctcctaattatttccgactaaagaaacactttcccttaatttatatataggtgacctgaccaccactccttccgatcatcatgactcgacgtggctcgagacaaaacttttaatataa

SEQ ID NO: 4671 - DNA, 2000 bp, Arabidopsis thaliana
gtcccatgatgtaactttaaatcttagtataaccctatatatttattgcatagatttggtgttgatgtgggattaatgtggtccttaagaagtcatactccaatacaaattgtttagtcgtatgtggactaagatagattctgattcgcttgtcataatcaaatcattcataatacaattttagtgtttatattgtgtgaaacacgaacatagtccaccgcccaccgccactaccgttttaaattgaaatttgtgaacaaataagcgacagtcacctgtctatatactttgaaataaaaaacttaaaacaaaagtgttcaaaaagaataatctctaaatagagtaataaacaaacaaaagatctccggtacattacaatatagtaatgtcttttctaagacagcgaacaaatgaaacaagatcaattttttttggactttaatttcaaaagctgcttgatcgatccaacaaagaaacaaataatttttaattcttctcaaaaaataaagtaataggataaatccaattatccattttaaagtaaaaaatttaacgtagacgattgaaaaacgtgtcccttgtttcctactttctcgaacattcattctttattctttttaattccgaatagttacgcttacgatagaaaattaatgagcttacataaatttaacttctgacatttacggatgctttagaagaaaaaaactaaattactctattagtagtactaattgttatcggaaacatacgtttgcttggtacattataataatggaaagaatcttaagagataaatatacaattactgggaaagggccgtacattacattgataagctcaatagtctccaaacctgtgttgcctactgcgacctactctctctctctctctgtatgcgttatctccgtatcattttttttttttatcaacgtgtctttgtttttccacgaaagataaaaaatcatgtcattattattagttttgactgttgttagtactaatttaaactttaaacatatgtgacaaaaaaaaaaaaaaactttaaacataaaagcaacgtcatgaccaaactttagcattattagccacataagtacaattattttcattttttgtcaaaaaattgatttataaggttggtaaagaaaagactaaaatatgtatcatgatgttttcccgataattaggtaccaaaaattatagtcatcgattaaaaccacaccggtgaattttatctctgttgatgtttttaaggaatttttttttacgttttactcattttcaaatgcctcaaatatttcaattaaacgtttgtgtgtgcctatttcacataaataagcttgtttgggaattgtgatagtcaaatattgcgaccatcattacaaatcatgttttttttttcatgtcactcaccaccatgaattctatgtgagttttttccttctttaaatagttgtatccatatgtagtataagttaactcgaatcttagcaactaaagctaaacaaaatctataaatccaagtattaaaccacaattaaagatgtgtttttaagtgtgtgtgtgtgtgtttatccattgttcaaagtccaaaactgaaaactttgaaaacagagccatctacgtatgaagagagccgacttcatagggatgaaaaacagagcatttcactgtttacaataatcccatagccgactcaacaattccaaagctaaacaataataaacaaatcctcataaaaagacaaatttcaaagacaagagagaagagagagatagagagcgtggcctctaatcaacccaacaccctctgtcaaaaacaagcctgactttcttctccatccccatttctatctgcgcatgtctctctctttcttctccataaaaaaccaaattctcactctctcataccctaaagtttcaacctttaaaccctaaaaccaaaaaagcttcagtcttttgcatcacttcccttaaagcttcaacctttctccgatt

SEQ ID NO: 4672 - DNA, 2000 bp, Arabidopsis thaliana
ctagatagacaccaaaagtttttttataaaacgttcgcataaaaggtttgagacttgagaacattgtatgtctagtgtaatattgacttgagtaataaatttacaaatggttgaaaaatacaattaaattttaaaacaaaataagtctaataattatttgttgtaatactacaacttgttcgttttgtaattaatgtgatcaagctggatatttttcgtagtattttatttaaataatatttagtttggaagcaagctaataattttagaaatccctgtctaaccatttttttgttaagacatactatgcaacgagatttaatttccaagcaagccatgtgatattatattttccttactctacttcattcacatattaaatttgaatgactaatgacaggttatgataggtgttcaaaacatagccttttaatatttggtgtaacatatatatctattcaaacatgatatacataaatagaaagcccttctatatcctctaaccaaacgaaattataacacaaaaatgtagccctcaatcaaaactgttacgagcatatcaacatgcaactatagatattcaatatatcaattataatacctagtgacaataaaacgatcagtaaattagtaattaaaaagtgtaaaacatcatatcaaagtagatttgaatccgtattaaattggccactgcaattaacacggcggaaatagtctcaagattcctagttatagaaagaagtttattgaaattataatatacagaaatagtaactcatgttttcggaggcatataaaaatacacataaatatctatacacatgcacacacacctaactttgttgatgaatttaatagaaataaggtagagaaagagagagagagagagagagaaagattaaaaggaaaactaagtgtttaaggcaatagacagaagagaagatggggaagtactaagagagacgcacgcagaatatgtgagctaaagtgttgagtggtttttgtaatttaagattgatacgtaattacttacttaagccaaattcggttggtggaagttgagatggcttaagacaacttcacactatcacttttgtgtgtgtttttatttgtctcctcttcactctcttcttcctaagttcacattcttatccaactcacattcttttatcactcaaaactatgaatattaaagttaaatattagatcaaacatcaaaagaaatgtggtctagagaatatcttttagtatccacccatagactctttcatatctctttttttctataaattctttcgaatatccgtattatttataattaacaattcttgaaaagtttagtggttcgtatatataatcgaagaattcaatggatatcaacaaacggattgatgcctaattttatgttacgaaatgagagtttaaaaacgtataatataaaggagagagagactctcttttcttcatatgcatataaactttggttcagctttcaaatgtaaaagagttgtagaggacaaaaaatcaagagtgctattaaatatgaaagaaatacataatggtaaatggtggactttcttttttttgaaaaaggatttggtaaatggtaaatgttaaatggtggacttatttgtaaggaagtttctcttatgttttaatgatagaacatgtgaagtcttcttccacatcaacatgtccccacttatctcctaagtagaaaaaatcaccttaaacttgttatatcttaccgtcaacgaaaatttattaaaattccctttcttcaaaaatactattaaaactcaatggttatgtagaacccactgggaaattcagagctggcgtttcctcatccattctcatatattctcttatataatcccctttacaatctccacttcatttccatgcatcttactcacttcatcatctcttcttaaaccccaaaacaaacaaacaaacaaacaaaaaataccaaaacaaagaagaaaaaaaaaataact

SEQ ID NO: 4673 - DNA, 2000 bp, Arabidopsis thaliana
tgtatgtacgaatgttgctaccctgttcgctgtccggattccaatatgataaatatgcgtgtgagtacaaacgaaaaaaagactattatagaacattaaatctttaaattattgagttatttacgtgttaaggctcaatgaatattcgaactaaagttgtgacatcaatttacaagtaaatgtgggctttccgtcttataaacttttttcatttcccatgacatgtgtattgaactcctttaatacaataatgaggtgaaaactttttaagataaagatttttgtaactccactagggaaaaatcattgtatcaaactttaaaaaatttcgaaatacaaatgttaaaatagaccacttagcatgaaatgttcgtatacgtatatagatcgagctttaagaactttgtactaattaggatcaaactataaaatattttgctaatatatcaaactgtatatgattatctcaacagaaccttgttgtaacttgctataagccatgttgaaagctggttcaccagccgggcacaagcttagctcctggctcatcgaccgatctgcgatacgactttttcagtggttaacaatagtaataggtccctccactcgaccttttttaatgtatataaaaagctaagatgtgagcttttttttctggacatttaaagttgagttcacatgagaccgaaccaaaacatgaatctggctataataaagcgacgtgtatatgtaatatatataagtctttgtcctctccactttattctatatgaaatgcatgtggccgttgctccacattttttgtttctcatcataaataagctaagtaaaggtatctaaaaattaatataattatagtatactaaatttaattttaatcagaattttgtactagggattgtgtgatttagaagtctaggcgcatttttcatccttattaattatctttccttagattggtaaattattaagcgaaaaagctatgtaatgccgtatatatatttatacaatcaattatgattgatgcagcattttaaccaaagagaaaacaattcaacattaagataaaaattaatttattttctatatttccattaattttctgttgtatatttaaacattatttacgaaacaatatattttgattcaagatttaacaattaaattattgaatttttcacattatatttctaatgaagaaactaatctaaaaatactctacatttgatgtatccttgcaatcgaaatattcaatgtttccgtgtagcaagcaagtatatatacttaactttttggtcataggttaacttatagggttctttacaaaaagcattggtctcatctctcatgcaaagcaccagtttggttcagttaattgaaaagtatgttccttagattctctgattgaaacgatgattctagtccctctccagtgtgtgtccatcccgtgttaaaagaaattgacaaaactaaaataaagaaagattgccattctctttaaaaaaagattgtctttctctttaagaaagattattaaacagtgaacataaagaaccacaaattactctattctgactgtaaatatcataattaaccagcatatgttcacatacaatttttgttttatctaatcactaactaaaatgataagtttattgaagataatatggaattgataattttttgttttttttgttgaatcttctaacaagaatgagagaaaactatatgaagtattcaattccaatatgaaaagttaaactttttctaggagtgtaaagaaatatctcattcttgaatttcttaaaacgtgtgaaatatggactgttttcttcatcactaagctattactggttacataattttcaaatttgttaatttatttttgttatatggacccaaaacaagctattggtgccctacacaatatttcctgcttttacaaaagttggctctgccaaataaaaattttcaagtttttaaccccaccatagtgcaac

SEQ ID NO: 4674 - DNA, 2000 bp, Arabidopsis thaliana
agtaaagacactagcgagactctggtgaaatagacaaaacaaaacaaaaataatcctaattttataggtttttggttaatatcatgtgtaatttattattatttttaaaatgtttaaaagtaaaaaaaagagttataaagctgagtttttaacaagtgtcaaaaaaatgaaatttgaattttaagttttagattttcaatattgcatataataaaattctggaaataatcatattattattttccgtataaaatagtcaatgttaccttacctattaaaatgttaatacatatcacaaaattaaatgctaaagattgttttccaagttaaatttgaaccattaagctgtctttggaaaaccaaataatatttacttatgacaattgacctaaactatatacattaaacagatatggaaataatcataaaggcataaatcttttcaccttttttttcttcttctagaaaacagtcaatattattaaatacgggcataataacttcttactatgaacgtttagcaattagcattaagctctctttgttgaaaaaaaaaaaaaaaaaaaattctctgttcttcttttgtaattttctttttatcaccttcttgttcttctttgtttctattttttattggcttttttcgtcttcgttcaatctgaatcattttttcatgactattttttaagttgcgttttcaattataaaaaaatttgtttatagattgattgacaatatggacaccaaaaaaccatccgatccatatgttcgagaacaaacatgttctcaaagatcaattcaaccaccaacaaatcaaggcaaggtacgttatgaatttatatatgaaactttataatttgttttctgttcatatttaagtacacattcaatatatacatattcaaaagatgaataaaacttcatttgataaaaattataatcttagttcaaaggtctatattgataattccattagaattcttaacatagttttcatagaacattcattcatacctctaaaaatccctgtggattggtttaatctgttttaatcgttgatttcggttggtttagtgaaaagttcagcataggcttttatctcttgattttgggcttagttgttaaaggcccatgagttcagattttctatttcaaaccgttcgaaacagagtagacctaaacagagtaacgaacgactctagtgaaggtagcttgttttgctagcaacgaaagctatttttattggtcattgcaatacgttttcataatactaataaagcaattagtggtctagtagcatttttttattggatggtagatgcaaaaagttttctataagaaacccgactagattagccaaattacatgcaacatctttaaaaatgatttcgagaagctgcctaaaaaaagaaaaaaggatttgaaacataacccattttaaaaccaaaacataaaagttgaattggcctatcaataagttgtcaaaatggtaagttttggataggctcatcactcataaatcaattttgtttactctctttattcttagtcaacaacgcgaatttccggatctgattagtattatttccataaaataaatgaatgtatgatttgtcaatttgaaaataatacatgacatgtgatgtattgtttggattccaagttctcaccattttgaggattattgctttactacaaaacaagtccctagtcacattggtcatttcttcgttagtttaaaattatatataactcaacttgatgattcacataaatcgaagatcaagacttttctagtttaaaaaaaagtggagtcacgttacgtagttcgttgattgtcacaacttaacaatgacccattagaatattcaaaagacttagtattatatacaaatgcatgtttcgtcacctttaattaagaataaagagttgtaatcacgctagatatataactcttttgaatcaatctcctagttatagctgatcatactaaagtcaac

SEQ ID NO: 4675 - DNA, 2000 bp, Arabidopsis thaliana
ttttgtttactgggcattttcaggcttctcataacagttattgggaatggtcaaaatgtctacaatggattttctgtttacatcaattcaaataatgacccaatgttattttaagactttttaatctttataatttgaattacataataataattttggaaatacaaatattaaaaagaatcgaaattccatatttttaacagtaacttggattaaaaacattatataaagagtaaaaaggattaaaaatgcattggttcataaagaataatggtaaatttgttgttttaatctttatatagtgtttttccaaaattattctttctaattacaattaaaatttttttacataattaattttaatggtaattatgtgaatggtttcggacaatgtacaagttgtactcatcattattccgcttattttcataattattccgcttattttcattgacacaattaaatcttgacctaaatctaaaagattacatataatatattttatccaacagaaaatataaattatttttaaaaatagaattttagtgggttttggggctttaagtgcactgatcatgtctggtccaaaattctaatattgctttccttttttatttttattttgccaagaaaccaattccgggtttaacttccttgtaaaaccatccttttcatatatatgatatttgcagtttagccaaaaaaaaaaagttgaattttaatcaacatttttaagcacgacggtttcaactagtagtaccatatcgcgggttataccattaccggaatttattagagattttcaaaatttacctgattgaaaattagcggattgtagtgttggagccaaactggattagtgactgagtcatcgggtttaccgggccaaccgcggttccgctcgaatctgaatacatttccctcgtcaaaataaaaaaagtcagaggacgattggtcgatgagaaaaacatttaataaaggaaaaaaaaatgaaaaaacaaatggggcctttggagcgatgtgatgacgtggcaacccccggagactttcaaatagcatattgagagttttacatgcatgtgaatatcaagggtaacatctagagtcatatgaattgcgcgtgttatgtcgttgttagtcgttcatgttaacaataatctacgtataccgtttgtgacttttaaaactaagttcatgaacctattacatatagatcaaaatctggaccataattttattggtgtattgttagaaacttaaagttcatatcactttctctatgtttcgtggcctacttgcaattttttaggaatcttttgaccattagttttttaaacgagtttaggactttgatcactaaggtaaatcgtttaaacaatttgggatcacttaattattgacatgattgtatgttttgattgggcatgtcaaacagatctcaatatttatgtaattacaaattattgcatatttcaatacatcaatgtcatggtcttcacaacgtgcctgacaaatcctagttgtttggattccaaattgttaataattcacaagagctctcccataggaagtttcttcgataattctgaatattatataatacaaaatcacaatttggagtttaaagacttttcttctattaaacaaaatagagtcacgtttggagttcgttgatagtcacaacttaacaatgacacattagaatattcaaagttttatcttattgatcagtgattgacattaaaagttgtaatcaagttatataagcgttgtaaactctttttgaatcatcttcacaaactaaaagtcaacatgtatcatatatttcagatctccggcgaagttatcaagggtttgggattgaagacgaaaattctgataaccatcgtctttagtaccttactaattttgtctgttatgttactttcattctcaaacaacttcaacaataaactttttgctgctacaatcaacggtaagaaagaaaaaaataagcatcc

SEQ ID NO: 4676 - DNA, 2000 bp, Arabidopsis thaliana
gtacaggattaaaagctatgaagtacgttaccaattacaatctcaagattctcaaccaccggattataactacaagtaccgatttggcgatttgacgaatacagatctatcaattagctagaaattttctttccatgcattttcccaccctcccattagatgatgatgattagaagaccacgatctcattggtgttcactgattcaagagcatttcaagagaatataattcttaattatgaatttgttcaataattaatccccaccccacttttccaaatcacccttacatgttcaccaattgtaacaaataattaaagaatcaaaagtgatttcttttttaatacttattgttgggaaatacttaatgctagtccataactctcttcaattatttaaaggaggagtaagtaagtttttttgcaagtccttttgtggtatccatgtgagttatacattggggagcacaaacttccccactcccacaagccacgtttgtcgcttaaagtttctaagtttttttaattttcgctctttttggtttgttatttatgagtgtatggaagtggagtctcccccttgaacacttcaacatttacactactaatcccgacttagacgacaaacattttttctaagttcgaatgtaattctcctaattcgctttgacctgtttttgaattttatactattcaattttaatttagatatttatctactttagacttgtagaaaattgttttcaatacgagcatatttattacctactatggaaccatttacggatttaccaccataaattagacaccagtattcatataaactatctctaattttgaatttaaacaaacgaaaacaaaacttaaatcttcaactggctaacaaaattttactcatcaataaaacaaagcagtgcattttgttttgcattctaatgtctcttttctcttattcgacctacatcaatagtttcatacaaacaaagtcattttggagcatttttggtctttgtttagacttaattatttatgtaattaggtttgcaaaaaggctagtcatctgctttatgcttactgtcaatccgtcatcattagttggacatcatgcacgagatttggtctcaacaaaaatattaacctatttctacacaacattcaaactaaggcagtcaaaacttatgtacttattgaaatactaattgattagcagagagacgttaaacaatgagcttgaacttgaagtaatcatgttacaacgtgttttggttcatgcttagtgcttaccatcaaattctgcgatttgtgttatttccaacgtatagcatgctacaaaccactcacatgattacacatggaatcgtacccacacgctcgtcgaaatcgcacgttacgcgcgaaactgagtcaaagaggtttatatctgacgtcatcgacacttgaaaccgacatgttttcacacgtggcaaggtcccactggtcaccgacaactacaagaaaaaactgccggcgcagatttagccgtccgactaacgtgcgctttcaattacattatacagaagtctctctttctttcattgacggtgatgaagaccagctcaaagccaggtcaaaatccatcaatcctggcctcatcaatgttaaaaatctttactttcacacatctctagatcttccatagaaggatcaatcaaaagctgtaatctttctttcttcctcgtagctccttctcttgcggatccttgtcggtacacttctacattctcaaatctgattcctttctggagttgctcctgagctacggttcagcttcaattacttcgatctcgtgtaaaaatcacttctagaagctttgataagctttgataggagttggttttactctttagggttttgtttgagtttgatctttattgtatagatgttgtgatcttcgtacactctatatatgtttccaagggtttctatgaggcgtcgctctgctgaagtttctcctacagagcca

SEQ ID NO: 4677 - DNA, 397 bp, Arabidopsis thaliana
aaatattgcgcttggtaatggttagaatgtatactggctataatttaccataatttctgaacattagcatttagcaaacttcaatgattgaagatgagaatcaaaacctcgtaccttgaaaatccaaaatcgcggcaaaaggaaattacaattcccctcggttaacaaaagtctctcccaaaatcaaacgacgtctctgacactctgcaaatgccacaccacaaaacataatcccataaatagtataatacccttgaccaacatcttcggcaaaaaaactaaacacaaaacgtttttagttaaaaagtgatcaaggcccataaagggcccaacgaatattaacacctaatctgttgtctccttccgccgccgatccccaaagaaaaaagtaaaagaa

SEQ ID NO: 4678 - DNA, 1759 bp, Arabidopsis thaliana
gattattttttagtatttgtactaaagaactactgtaatttagttgtcatacttttagcatgaatcattgaatttagagttgggttgatgtaaaccaagctggttagctttcttcataaccgtatgtactttcatatcatattagagagaaaaaaaaacacaatgttgactaattaatgggttctgtctaactagaaaagtggaaattagttgtacgaaaaaagaaaatagcttatctctttctttgtaccttagatttttccttggtataatggatatcgatatgtccaagtccagtgtttgagtgaccaagttgttgctttaatttaatctagttcaaatacgactacttttgtgttgtacctctctaccttaccttcctcgaattttcaattcgtgtgctagtttgccaattgtttctttataattttgtcgtctctatgattgtttaagcatatttaaatatttgagagaaaaaaatactaagagttcagtcgtattttgaaaagtcctcgcactccaagttttaaagttgaattcattctgtcatggaaacgtacctttgtggtttttcatttcgatagacattttttaactcttctgataaattcaaaatgtttttttacattggttaaaatttgttgccaatttcaataaagctttttttttactcgttataaaattaaaaacttgctgagaaattatagtttcatatatactttggaccgacggtcaataccaaaaaactaaaataaaattttggtcaagaatcgggtcaatacaaaatatctccaaagatcgaagagaaagttcaacaggattttaatttaattggtgttccggacctgccggcgccgtattataattcttcaataaattttatattttggattgcataatcaaaactatttgcatagcagacatagatttcaaaataaattgatacgtaattagctatttacataggcaagacaattttacgttacatattttgcatgcttgatattcattctttttttttagcaacctttgctatattcattctattttttcccctttttttgctactatcaatatcatatcagatgtggcggttcttatgcatgggattatgaaaaatgatattatataatagatgtcttcgtagtatttttttattgacaatcaaaataaaataaattagtttaagaaagatcaaaagtctagtgtcaaaatgtccactgacaaaagttagcagtttttcttttatgtaataatccgattataaaaaattgcgttaaggaatcataatgagccatgtgtcagtcatatttaaacgacgacgttggcagcagccacacgtacagcctcaggcaagcataaatagagatgggctctttcctataagtttcccactttgcaaagtgtaacacaaacagttctctttagagaaaaaaagattctctctataaaaccttctctttgtgtctctctttgtggtaagaaaacagagcaactagatctctcttctcctctgctcgttcaatgttataacgatctcgagtatcacaaaagaacaagatgtctattcgaagaatctaccgatgtctgaattctttaatcaaaagatcttgtgctcaatctctatgatcatacgccccatttcacactttgtttcacctctcagtttttttttttgtgtttttttgtccctctttgtttcacttgagaacaaccccctttgaactcgatcaagaaagctaagtttgaagaatcaaga

SEQ ID NO: 4679 - DNA, 2000 bp, Arabidopsis thaliana
tgtgatacatatataatgtgattgccaatcattacaagtttttacttagacccacacatgctacgtcacgttttaaaactttaccttatgtccaatctcttttatcgatatttatttcatatgtatgtataagatattatatatatatatataggaccctaatgtgtttataatatatatccgtatacgtacgtacaaaagaagtacgtatgctgattttgattggaagttgggaatggaagcatggatattattcgtacttccacacattttattagcactttagattacctcatattacatttaacctcactaaaaggtaagagttacgagactcttgcttgcctaacgtatgctaaaaggtattcatgtattatgtattcatgtttttgtacatcatgcattaaacctatataaaattgcatacttacgtatttatataaagtagatagcatatgtattatacggatggaatgatcattagtttttttgcgcaatcttacatcagagccttgtggcgtggatttgaagtctaaccatgccatgccatattttaatttatggaaaacaccaatatataatttaatcatcacaacttatagtctaaacaactacaaaattaatcatcatacatcatgatttggatgtacaacttcgtgtttaaacttttattttatttttctctttcaaataaggaactttgcgttctgaagtggtgttttaaagataagtcatttatgaagtcatttatacgttagatataaatattttgaaattttatgaagtggtgttttaaagataagtcatttatgttcagtttaaaacgcaatgtctatatataccagtattctctaattactaatagaaatgtgaactttcattattctttgtattaaaacttcatagcaaaaaaaagtaaataatattccctccacatcaatttaagtgatgttttaagggtattttgttcttgattcattataagtgatgttttcaatttgttaatatcttaatttttttggctaattatgttttacatcatgtttttgttattgtctgaaaactgaacttaatgatgtttttatgtaaaagagataaattaaatgaatgtcttgtgttttcttaatttatgcgtaaaaaccttaaacattagatacaaagtgattaagaagtaaataaaaggagtaaataagagtaaacttagatgatgatgatgatgatgtgggttgagttttataagaaatacgaagacgagtaaataagttaataggctaaagaaaaggattattgaattctccttctgaactaaatgtcaaataataagtgtcaggattaataaaaaataaactgatctgaattaattaggattacagtctacagatttattctatttatttctccaattggtgttacttttgtttgtggcatggcccttgtggtctttaacacacacgcacacaaacaaccgctctaaagtttacaatatactagatttctactcgctcatatcaaaatctaaagtcgaaaatctttttgtataaaatatttaaaactgaataatcaagaaatgtatcaaactatttaaatatttccgtgatgctcaaattaatatacatatttttcgtaactcgtcaatgaatcatgcataacttgtttacacaattatacttaatggacactatgatctgtacacgggcatatgagtaacaaaagaaatttaagagattactagttaaaatctgccgttaacttccgtacgttccatgcttttgggtctctctctacgagtgaagtgcctcaaataaataagagttttattgaatggagtggaaaatctaatctctaactaataattataaaacatcttctgacgtaaagagccgggttatatcaatgatatatatataggagctcctgataataatcaaaaacataacattgcatatatagagaaagatatagtgaaggtagctatagagaagaaagtagtgtaataagaa

SEQ ID NO: 4680 - DNA, 2000 bp, Arabidopsis thaliana
aagatgttcaaattgatgaaggaacaatgcatggtaagaatatttgccacttgatcatttagtccgcagtccgcacatgaattgcatctttagaagcagcactttgtccaacctttcaatggtgtagtaataaatatctcataataatgcaaagaatctctaaataaattaataatatctttcagtttctttcatactatgtattaaattttttatcatctcgatataatatttgtatattcaaattaaaattgattttctttttataatttagatttaaaactaatataaattattcttaaaactaaaataaatataataggttcggttattgaatttgagagacaattttgctacaatctttgtcccatctctatggatatgagaaaagttcccccctctaggaaaactgttcagtcacattccatctattcgctttgagttcatactttttcgctatattacaacacaattagtccaaattaaattcatataaaaagtgatgtcatcaaaactatattaataagttgcttcatcaaaatctagtagtatctaagagaatccccatcagtggaatgactcaaaaagttttttatcagaattatattaataatttattatataataaaatttatttattttaaaagaactaaatcattaatcatgtgacccttgtttggagaggttctagaggtatctcatttaagagagtctctctcactctctctacaactttttttcttttcaaatttttattagcttagatatccatctaaaacctatcgatagaagtgctctaataaagacttccgaattgaaataccaagctctaaactataaagctaaaatatatttgatgtatcatcatcaacttgtcttcacttatgacttgtcttgacttgtaaacttgagtttaggagtgcgcattccgagttactatttggtttttatagttttctagttttaaaatagtatgtagtagttaagtttggcagttgcacccaaaaaaaaaatagtttccttagcttatggtttatgggtttttacaaaaaaaaatgaaatcattttaaaacaatgtaattcggtttgattttggttttttcggtttattcctttcattttacaaagaaaaaaaaacaattttgatgcattacaaaaacacacattcactttaaagatgtaagacaattcgcaagtattgaaagaaaaataagaaacaacatatattcttgttacggacaaaatatttaacgagatcaaaagaagtaatagataactatgccaaggcgtaaaacaactaaaaattgagagaaatctatcacaaattcaaattcaaagagtaaatgaatatatttttttctcacgagtgtgtagaaaatctctccctaaaactcgagagtctccgttagtcaaatagctagtttgaacgccattataaatgtgatatctccaagttactttgaatgaataacgtacacctaagaaatgatagtaccacatcttcgccataaggcacaagaattaacgtgggagttgacatggcatgccttgaaccgttgatgtagacttcacaatatctgatgataatctccaaacataacctcagccttaaaaacctgtgagaactcctcaccacctcacaaactaatctctcattgtaatttttgttatctatagttttttagatgaattttgttgggaattgtcgatttctcttatgctcggattgctaaataattttttttattttttttaatggtttgattctataattctgagaggtttttatcatatggtttagtcttttttggcattttatctgaaaatattatcatcatccacgtggcaaatcctcgtcagccggctcacgagaacctcaattatccaatctttgtatgtcacttgagtctctatatatcaaaccaccgaaaagcacgattgtttatcgtagtgcgttacaagcgttttaagctctcactagcaagcaagtactagcaaca

SEQ ID NO: 4681 - DNA, 2000 bp, Arabidopsis thaliana
ccatctctataccatgaacgagctcttggaatttgaaatgcgctgttattaatttgttgagatttaaaataataatgtaacctcaactctgttttttccataagaaaaatctcaatgagtaacgtgataaacctgacaatatgaaccaaagcgtgtccaatgacctgctttgtgctcagattagacaagtttcgggccacatgcactccattagaacaaaatgataaattttggtggaatcaatttaagaaggtagtggattcaatttgagaccttttttaccctctttttttgtttgcaattattcttgcaaggtaatattcgaaatgattggcaacaaagaaaataaaaagtagaaattataaagttccagaaaagataagtttatacatctggctttggggccggctatatttacagttaattttcatatgaaataaaaccaaaaatcatatatatagataatagatgaaccaaacaaatgaggcgttcttcatataaaacttcatcttcacgtaagcaaatgtgttttatttttatctagtttctgcactcttttagaaacaaaattgttcacctttctgtcgttctaatgattccaatcaaattgataattactagaacttacaaacgaataaggaccaactcttctgtatttgatatagacactctctcaaaacttaatcttctctaatcttcactgtaaatcttaaggaacaactctccacaagtttttataatttatatatacataactaagctattacctatactattaagattgtgtcaacgcaaaattgagttattctttcttatttaaatttgaactattaaaaatatgtaaataattaacgaaaatctttgtcaaaacactattaagaaaataatttcaaaaattaacatgatgataaaatatagattgttaattgttttttttaattgttttcaagtaatttaatcaataatatgatgaggatgattaaggaaattactataatttatcttttaaagaatatcttagcataggtatgagttgtttttgcaaaattttaataattgatttaagttatctaaacgttattaaaattattatccaaattatctataattatccgaacatattcgtctcttgtctattctggtagtgatattttatgtatctatattattcatatatcgtatcagtataatctgacttatttaaaaatatctatttgatatgtattttgatattaaaaatattttaattcgagttgtgtactcgtaaattatccaaaagttttagcagaaataaacatatctacgtatatgttggtgttgaaatttttttgttgaatttggctagtcagcaaaatttagttttatgcaaatggttactgcagaaattactgaatctggtttagtgttaccatttacaccctatatttccgtgaaatttgtatgtttaattctacttcttgcctctaaatgcacgatcttttcagcacttcgaagaggttaaagtgacttttacccgatgagaagggaattgtgtggcagatagaattgctagggaatctctttcttttctgaattatgatcccaaattgtattctatattgccggattgggttaaagcttatgtgtattcagactcttgtgtaattgtaagttgttgttgaaccaaaaaaaaaaaagcacgatctttcttggtactcgtagtaacaatagatattttgttgagaattaaaaataaagtagaagagaaaccagtaatgcgtcagacgtgattaagcgaactatataatataattgatcgataatcgtttgctagtgcgttaaataggtgtatagtaaaatgaacctcgcgctacacgttattatttgtatagtaaaatgaactattattttcattgccaaattgtagtacttgcaatataaatataacgaatcggtctacgagctaaggcacaaaagcaatcttcttctcttttcacagttctgtttctccctctctctaa

SEQ ID NO: 4682 - DNA, 2000 bp, Arabidopsis thaliana
gaaaaaaaaattgtccaaaaaaaaagaataccatttgaatcaaaatgatttaaatatctaaccgggactacaaaagaaaatgttatccaatgggttgggtcttgttgtgatcaaatatgtgagggccaaattgttatgaaacaatatttaggcccagaatagtctcactaagtgcaatcaagcccatgaccgtcatacactaagttaataatagatataagttataacaaaagaaataattgaaataggaggagaagtaatgaatgatcagaaatgtgtccgtgaaagtttcatgttcttggtctcactttcataatcatgtttatggtcgctcacacgtaattgtcgcaagagttaactacactacgttcagaagtgcattttcgtaattatgtagagatttcacaatttggcttaaactaaccaaaatgccctggcatgatgagagctcgtagataggctttttagcatttgtgttaactttatgcattcaatcttaaacattcatctatctaaccatactattttaagtaagacacaaccaaaccgatctctaacaaaattgaattaaattttataatgacacaaattttacgaaaactcgaatctaaccaaaaccaaatccgtatcatactagaaacttaattgaaatgtcgacccctaattcatattacatcatctgctaaagttagttgcataagagtacccacatcggttatttatttgtcggtgtctgtaaatataagaataatcaataaaaaatggtaggtgtttttagttttaaatttgtggttttaagaaaacatttgaaacataaaaaaaaagagatgattttaatttcattactaatttatgctaaagacatttttcaaaaattgtgtaacgaggatggtctaatggtgttttgtagagcttgtaatttaagatagtttttacgttggaatgaaattgagctagatccgattgtctagccgccagtcttcacaggtaacaacaagtcaacaaccgacacataaataaaataaaaaatttggacaaaatagttgaaaatattgtaaagtgttgttgttattttctttattttaaaaatgtttaaggtaaacgtataaaatcagcgcgcatgcaataaaataagtcaaattcaaccttttactactactactatattgaagtattttttttgtttttttgtagtaaattactattgaacaatgattaatggataataaggttttgaatatcgacaagtggagtgatgcgatagtacactgttttcgcggctgcgtatagataattgattgaattagacttcaacactggtggcgacttggtcaagattggcgttgtatcatcataattttttgtccaataatgttattacatatttatgatagtatatagtactgtacaaaaaagtgattatctattactctttctgttttaaaattagattttttagaaaaaaaattatttttaaaattgagtttttaaggttttttatgcaatatttattaattattattcatatattataaacttttttttgaatatttttagtttagaattatagattttttttttaaaggtccgtatttttttacaaaatctattatttagaaagagagaatcttaaataaattattcttataacgcaatacaatcatttttctttaccttatgaactttatttttttttgtgattagaagataaagtaaatactattttttctgcatgtcttttgtataagtttgtaactactaccactttcaacgccgtctcaaatctttcactctttttttttggattgcaatatgaagtacctaagaaatttcatataaggtgatctaaaatataacaaaaataaaatagtgtaatgattctctctgagcctacaatataaatgtccacactccctttgttctctcttcaccaccacacaacacaaaacctccaaaccaataatcagaacacagtgagatatttctctctgaagccaaag

SEQ ID NO: 4683 - DNA, 1416 bp, Arabidopsis thaliana
caaggaagcaattacatgtagtattattgcgtatgcaggtgtgttgctttccttcatgctggtagctatacacttctgcaacaagttaaagtgctgtggtggagagggatttttatccggagatgattcagtgagaacatgtctacttgcagacaaaggtgacaatgattgttgtaatgatgtcgaagcaagtaacaaaagtctctgtgccatttgttttgatgctccaagagattgttgtttcctcccgtgtggccattgcgtctcctgttaccaatgcggaacaaagtaagttttttatcaactaagtacaacttctggattgcataattgtaatggtaatgtgtttaccatattgggattgatctaaaatattgaacgttgtgatttgacaatatttgcaggataaaaagaaccaaggggaggtgtccaatatgtcgaaagaaaatgatacatgtgaagcgaatctatacagcttaagatgtatcattatctgtccaatgtgatgttgaatcgttagagcattaataaaaatcatataatttgatattgacaaggctcaggtctttctttgcattaattcgtttcatctcttaaccatctttgtgacaacatcattggttaactaccatagggtaggcaatatagtgaaccattgtttgttgactcacatcacaaaatggttcgaaacccgaatcgataattaaggatttcataaattaattgttaatttctgaataaattcggattttgtatatttcctccgtttcgtaatataagtagttttggaccaatttttttgtttcacaacataagttgtttttaactttctatgtaaataatatattattttaatattttttgattatttatattatgtaatctcttttatgattagctaaactttttaaaaataaatatttttaatttgcatatttttatttaaaacaacgtatattgtgaaatggaaagagtataaattattgattaaataattaaggactgtaatttattttattaaatttaatattcttttccaaattctccacatattttataccataaaaaaagaacaacacccttacacacataacatatccgaatcagtggttcttcgacatcacacgatggtatagggaaatgagcttccacgtcaacaagataataatctcttcgggactatacatttacaacaaaaagaaacaaatcttgtggtcaaagtttccatacgtagcttctcttctctacactcacgtccaccacaatcctcgtgctccttcctctaaacccgtccgattcacgtacttttactatcttttctcaatccaacagctcacagtccacaaacaaatttcaaatcgcgtcctataaaatcccctctcctctgctccacactctctcaaaaccctagaaaaa

SEQ ID NO: 4684 - DNA, 741 bp, Arabidopsis thaliana
cgaatcttcttgggtttgtcgaacaaaattaaggtgttgggaattgaaatctagggtttctcaggtaacaaccactgatcgagaatgatgaagattcaatcggcgaagattagctaatatattgattgatgataaaccgaaactcataccaaatataattgtttatcctgaataccgaatacgacccatcaattaaagcccatacaatactgggcctataagaaaagaaatgtaaattgtggggaaaaaaaaaggtaaatttacaactttataatatatgcctcaaataattttaacagcttgtttggtcttatatcttgtgatctttgactttcagtctttcacaatggaaattattgaatcttgcatttttattgaattaatttcctatttgtaacagaatactattattagagatatattgattgagaatcgtaaaagataatgtagttgtgtgacaagtgagattcaagaaaagtcaactatatacaacgagagtagcaaaaaagaaataaattcaaatgatttggaaaattgaagaggggaccaattcttgggggtaaggagtagactcgtcgccagagctgactttgaaaacttgacttggtctcattcttctcatctactgcaaaaaccacaatcagtatataacaacaacacatgagtgacttaattctcatagaccaatacagagatacaaagcaatagaacaacaagaacaagaaaacagagaaaaaaaca

SEQ ID NO: 4685 - DNA, 1100 bp, Arabidopsis thaliana
ttcacacaacacactgaagaaaaagattacaccggagaaattaaatgatctatgaataaagaggtctggaaatagagaaatgtgagctcttaagagttgttcttgaggagcttgtgagaaagattaattaacggttaattacattgttgaatcaaattactggtaaatggttaggtgaataatttaattttatgtatttgatatccaacattgatcgacgtacgtacgtagtgaggtagaggcttaggttaggaatcaatcgtgaatactatttcaacgttgattcccgcgagctgaatattttttgtgatgtatagtaaaacgcatatgattataggaatcatcataaagattcttgtcatgaagaacaatattaaaccaaattatgcattacgagcaaaataattatacaaaaatactgataattataacttgggtcattgtattttctgtgtaatgtctactatcccttaattagtcggtttaaatcaggaaaaagtataattaatgacactcataattgtatcgttaagacttgaaagtgacggccaagaatacaattaagagccaattagtgatctttcataactttaaaaatctcacaaaagtagaaaaaaaaaattccaacttgatgaccaagaataatactattaaagagctatttaagatgaaaccgcccgaaaccaaaagcattcgatgggtacaccgattactgcttttagcaacaccacggcgtgaccatcaagactaattaactaagaccacattttaaaaaaactattaataattactacaatttgtaattaaaaagatcaacgagaaatgccacgtggacgaatactagcaacgccaagtggaaagagcgttcgagagaacaaggcaaaaccaaatacgcccctagtattctacagatgtcgactggataattacaaaagatttcaataaacagtactaattaatttctagtggtgagtttttgtaaatatctacttcttccaattaccagctgctatataaatccccttctctgtttctcttttcttacatcacaatcacacaaaactaacaaaagatcaaaagcaagttcttcactgttgata

SEQ ID NO: 4686 - DNA, 2000 bp, Arabidopsis thaliana
gaatatttggaagaattgggtggtctcgctttgtgccgctttcttagctcaaggatttttggattctatctacatgaacttcgttatcaattttgatgcttgatatttttgcctagagtgtttcagtttttttgtttttcttttctttttctagcagaattgtcacatgttatattcatattttgagtattttctaagaaacaattaggatgctacatagacatatttttgaaaagaattaagaaaaagtaataggttttggaattttgcaaaacaagcgagaagatgctacacttgattgttttcaacaaaaataccctcagaaataatggatgagattcacatgatagcactaaatcgctacaaaatctcttcactagtgtctcctccatagtcaaatccgagctccagataaaaacattacagattcatatgacaatattaattttgtcactcatatgaatttggttaaatatataatctaatttgaaaatacaaaaatcatgattcatgatgcacctttcaattcacataatgttgaaatacagaaaaaataattactctctcatttctttataatataagttttagaaagaaaccaaaaattgtctcataaagataaatgtagatttttttttaattttatctcctattaactagggttgaattaataaaacaactaatgaatatttattaaacacgaatatatttgtagtagtaaaaaaattcttaatatgtatgcaaagtctaaaaacatacaagttcactaatctctactaaattaacagctaaacccaataaatccgttaattatggctagtttagtgaatttttctcaaagaaaagctcttttttcaaagttaaggagactagagagcaagtcatttgcttgtggttggaaacaaaaacccaaagcgacgacacaattaaaaaaaaatataaagaggagaggagaaaaagaggcaagccatagccaaagggttcgtgtcggcttcaaccaaacactgacggtgtgtgtatacacctttacatacacacctttatctctctctctctcacatctttgttacaaatcaatcttctactgttttctttttcctcttcttacattattttttgacagcaattcttagtttctcttctatcccctttctgggttttgtttgaaccctagctcgctttggatccagtggttttaagttaaaggttcgatttttatttctgggttttgcttgttttgcttggttctgcttagtaaatgttggaaaaggaggagactttagaggatctgtagtcagatttgagctgggtttgtcgattttactaggattttgattttggggataatctagatcaggaatcgttactttgtttcatatccaaaattcaactctttttctcgttcctgatctaaaaatcgttccttttcaagctttctaaatgaggtttctctttggtggttctgaaattttgtctgtagctgttgtgttcttctcttagatttgattctgtatgataattttaggttctgagtttgaagtcttgtcattgtagagatggttttagtaacagttttggtgttgctttgtgtgaagttattaaggactaaaatctgttcatttttggtatgttattgagcaggttcttgtcttgcttttgctttatttgttctttctttttacctctttgtttgagtgattattggattttctcttcaaattgggtaataaaattttgagaatctgagtcttgtgatgtgctttagacacaatgtagaacaaagcagttacataaatggcccacatttttgtcagtaaatttatgaatggggttttaaatgtttctacataataacatctatcagagttttgtttgtctaaattagaggaggataggtccatcttcttcttttctctttcagaataacatttcaatcttatagttttctcttcttttgttttgttgcccaggtaaatttatcgaaagtaagtagattccta

SEQ ID NO: 4687 - DNA, 1960 bp, Arabidopsis thaliana
gagtccagcgaacaagacaagaaacacaatcacagctatatgtataaagaagtttgggctgcaacatacatactccaccgccattcaaaatcgactctttaagagaaaacaacaatccccaagagctcaaaaatcggaaaacacactaaaccctagctcactcgcagagttgacatcttctccttctccaaaactttcttcagaatcaggaaatgaacagtctccgactcaattagtaacgactaagatcggaaaaccaagcacgaagagagttaaagtgaagcccagaaaatatctgattaaaaaaagcactttttgtgttgtgtctttgcagagaaatcgaagcaattatggagagatgataaaacaaacaacagagtctcgtgcggtggagatccactgccatatatagaacgtggcaattagatattataatgacaataatacccctgtagtgagggctacgtacgtgagatgacaaaaggtgttttcgtaaatttgacggtcgtgtcctttttttaatggtgacgcagcaactagctgggttttcccgctatgacgaggattttgatccgatacggattctcgccacaacacttttttatgtgtcttcaaactcaaagtgttttttgtatctttttattaaaattaattttgtaaaaaaaaatcgtaaattggacttgatcaattaccattttcttttttgaatgattggctagtgtagttttgaaattcttattattatcaaaaagctacgttaccaaatttctttttccatatattatgaagaagagaagctttccttatgaactactactttttgggtcggcaaaattctttttagcaaaaagcatattcgagttctcatataatatttcattggattgtaggttatcgagcaagatcatctttatccgttcacaattgataatctggtgatcgaatacctacgagatcgccgttaattagtaaaagtcataagaattagattagtataaaacatagaaattatttcgagttgtcgggatataattagtgttgtatctatggtgttagtaaaaaggcaattgcctaagccaccaattttttttaatttttaggcctcaaattttattttttaatgactattaggccacattattttgttaagaaaatcattccgccccaatgtatttgagagcttcaagaaaatcattgcatcccaaattatttcgtatttatattttttttgaagactctaagaattatttgccgtgggtcaaactcttatttagttttaacgaattttgatacataaaaactaatgaatgtatttaatattttttaacattaaatttaaatatatattttttattagttgaattagttataattaataatattttataatataaaaaagatacattaaatgagataagaacgagttttcacaataaaatgcattatttaattagcatcatcgccatacattcacgtgatctactaaatatcatagaaattaaactagcataaaactgagaaattatctagaggataaaaataactttgaacggtagtatattctaatgatttgtacatttttgtgcttcaaagtttctccttaataataataaaataaaagcataccaacgtatatagaaagatatgaagaaattgtcttggatttttaatacagtaaaaatcatttcagtcaaatccttgttttaaatttatttacaaaggggcattatcaaggctctctgaccctttcgccttattgacttggtaaaacagttgataataataatacaattacttacaagtcgtgtcttcgttggtaaaaaatatctcgcaagtgttattaatcgtccataaaataactccaacctaaactctatataaatcctcgtttctaagttctaaccaataacacacaacatagaataaaagagcttacagacaactaagaaaaaaaataaaa

SEQ ID NO: 4688 - DNA, 889 bp, Arabidopsis thaliana
ccactttctttgtagtttgtatcctgtagtcaagtctctcaaaactctcaagttaatatatataaagttaaccgaaatcatctgcaaattaaattactggtttagattggtttaagtcaattagtataggcccattgttagcccattagggatgaggcggttcttgagggtttgtcaagcataaaataattcagacaagccggtgaaaaagaaaagtcgtacgcgactctctctctctatcttttatttcctttgggagcaaggcggtctatcactttcagtcgctatatataatcttcctcatcgctccattttctcctacagtctctttctctctctccctgagaaaacaagggagactaatcggaatctcctgcgtatttgattcttccggcgattgtttccttctttatacgctttcgtatattcttgtcaggtaccaaactttttccccctctttggttgtgagcttctaatcatttgttttatcgttctctttgattcagcaatatcgaagccaaaatttgtgtgttggttggtgttggtcaccaaaatttcttagatatgataaaatagggcactttgattttacccccttttttagatcccaaagaaggaggaatagtttaggcgtcttgctatcaattttcgattcgtttgatttggctttagttaatttcaacatcgttgtagctgtgtaagattttattgttacgtagattggtttgctcgtattttcgtgtgtggtgaatttatctgggccatcaatgtttgacattgctagaatctgaatgtttctcatttgcttttctttttgtacagaagcaccattgctccaacagtgacgggtacaggatctagttctgtgtttgtggagtcaaggcagaat

SEQ ID NO: 4689 - DNA, 1045 bp, Arabidopsis thaliana
ttcttcaattcgataaaactggaagacatgtcatatacgatcttgtcggtatataacatctgtaaaagcccaactagattcaaaagcccactactggcccagcttcatttagggtttttatgtatcttctattgttacgtgtgtatacactcccttcaccgcagaaatacagaattaaaaaaaaaaagttttgaacgatgatgatctcaatcttccaaagatttgatagaggagattctttctaggcttccctcgaaatctatgaaaccagtgagattaacttacaagagttggaacaatatatcaaaaagtaagagctttacaaagatgcacattttaaaatgttaactaaaatacacaaatttaagtctttataaaattggttatatgatatcaaatagagtacacatatctaaagttataagagaaattattttaaactatccttttcatctttttctaatagtatagcaccaatcaaaaacaacgtgtcaatcaattgtagataaaatgtatcccaccttttattatataccctttttatcatacatcttcttagataattctcatccaacacgtaatcgtataaatatagtattaaaatccaatctcttaagaacaagataaacaacattagaaagagaattattatccacgtaaaaaaatcattagtctttaatagttttaacgttgactacataatacaaacgcgtggtttcacgcactaaagaaagagcgtgcagcgggaaaatttgccgtcattaaaaactcagaacaaaaaaaaaaaacaaacagatcgatcagaaataaatagaaaaaaaaaagattttcccttttttaaattaaaatttctttgtttcatcctctggagatagaaaaggaaagaaacaatttacaaaaggccttaaaaaagcaaagattcttcgctgacttcgttctctctttcgctggcgaagaagattttctagggttttttgtttgattttcgtgaagtcggaaaaattattattattaatcgtgttgagctgtttgatcggtgaagact

SEQ ID NO: 4690 - DNA, 2000 bp, Arabidopsis thaliana
caacataaaacgtaactaacttagctatctttctacattttaacccctatgaacaagaggtgggttgaacctattaggctattacatgtgacccgctaaatagccaaatgtgggtaaccacctcaaatcactacaaggctcatgtcaaactctcattaccattaatatccgggaatcaagtttatcagaaaatgagattgtcttgcattcaaactaagaaaagaaaaagaaaaaaaagcaagaagcaatggagatgagtaacgcaatgaatgagtaatagctcaatgtctacataattggactcgtacatatgaactcaataaaataaagcaaatggacccgatttgagaccagtaatggttttgaaatcatatatttccaagcgtaccaaaatacacttacgattaaaacttgaattttttttggcaacaaacgaattatatttttgttagtattaattattgtattcaacgaattacatttgattggccgtatactctggaagtgtgtaagtataatattttctttggcttacaaagcaaaacaaaaatttgatggagagagtcaaacaaaaaaacaaaagaagtaggtcatatgtttatccattcatacgttggttggtaatcctaaaaaccaacaaacaatcatatatgtatacttgtccaattatgtaaactactccattgataatataattgttaattattgactcgacttatctactgattatgaaactaccaacaaatgaagaaagtaaagggagtgtgaaaacaagaatcttaaggtataacgaagatttgttccgcgtggaaaaggcattaaaagtgccacgtcactctctctttttattttatgattttcgtatctcttcttctacttgcttcccacgtttccatcaagtttccgtacatatcttcttgttatctgatccacgcgatctttcaacgcgtacttttcacgtatttgtgttgtcatgcctttgctgggattgtgttagatgctcattgctgacggtagtttttagagaacattctagaaagaaactatttttctaacaaaaccacgaactttgttttctagttattccactttctagaatacacctgaccaaattagaattctagaaatgaattttaaataaaccaaaacacctaaacgaaaagcaaaccataggtttttggttttaacatatttcaaattcataaaagtgaaaccaacctacaccatattaaccaatatttattagagtttttatatgttttatgatattgttcaaaacttcaaaagagatttattcatataacatacctataccataccaatgaatattaaaattatgaattagtatccttatattatatgaagtcaatcaaaaaacttagaagcatttcaaacggaatcaaaccattcatatatgaagtattattattatatctagaaggtgttgattttaaactattccgtataatatatctagaagacggctccgcgcgtggggaatgcatcaaactcagagagtttaatagctttttttggttgacgtcaactactcaaaagagtttagtttttgatgtgtatatatccaaataaaatatctttaaaaagaaaataataataataaatggtttcgagaaaacacgaggaagattctcatccaaccgaaacgactctttcgtttttagtagtctcttaagctacgcggtgtcgcaaatcgtgaccacataacccgttttttccttcttttaccccttatctttccacgtatttacgttaatacctacactcttcgctgccacttccttacccaccaagtcacaagggtatattcgtcactttccacacgtctttggtccacacaaactcggtatctatatatagttcccaaacggacacgaacacatcatcacaactactatcacaccaaactcaaaaaacacaaaccacaagaggatcatttcattttttattgtttcgttttaatcatcatcatcagaagaaaa

SEQ ID NO: 4691 - DNA, 2000 bp, Arabidopsis thaliana
attgcatttacattatgtagtagtctaataaaatataattatagataatagaaaagtcaatagttctaatatgataacaacaaaagaaaatgtatactttaaaatctgaaaattaccattcttttatttgttatcccaaacataagccatgtactataattaggttattgtaatttattataaaaaaaaaagaaagaatattcctgtacttcatgatttctttttgtaacgaagtacataaaattttcaaatcacatgtggtaaccatgatttaacaaaaaattaagtcggtgacaagcaacgaaacataaataatcgactttgtcaagatatgtataaaaatcgactttgtatttagagaacaaggtcttcattatttttcttttttaacattagagaaagagaactaaaggtctacttcaagaaaacaagaaactaggtgcttagctttaataatatatcaaagaaaaatgggtcaaaaaataaattattacatgagtggggcccggccggccacggaagtaagacctaacgaccagcgcaaccggtcaccagtcaagactattagaagccgggccgtcaaaatcgttgactcggtttttgtttccaactgtttttgtattttgttaaaaataaattaatactaataaataagctgaaaaaaaagaaaagagaaaaggtataatcacgtggaacgcgccgcagtaaacggagcggtggatcaaacttttcgtccgtttgatcaaacagaagagaactagtcaatgctctttcttcatatcacaatttaatagtctcaagacgattacgccacataaccattttctcgtgatttcgacatcaaaatttaataaaaggaactgattgattggtcatcatgttacaagtgtcaaatgagctaatccgttttacagtggcatagtttacgatcaatttacaaatttttggttttataacatacttgtagttaaaactatttataagctatttatagtgagttagcttataaaaccctattcttttatctaaaattatgttttgactcgtttcatgataaaattttatccttttcatcggaataaaaaactttattatttatttggcaaaataattggtgtaaaaattatgtatatgttaataacaaaaaatattaatctgattcataatcttaaaaaagaaaaatttcttgaaataaactttagacattgtaaataaaaaaacattatttttatataatgggatgtttatatgtaattttttataaaaaaataaaagttgtttactagtaatccgattggctttaactatcgtcgccaaaagaataatgtagaactgactttgaggtaaaactaaaagaaatttgtaagataatagtcacattaaatgctaaaattaatacatactgatatatcgtataaaatttatgaaaactacaccttaacctgaatcatacactgtaataaaaaaaacaaattatatataaaccctaaaaactaatcataaatcccaaacggtgtactctctattagctttgaaaggattgcccaattgtttgttaaaaatttctaataatagtacaatgttttgtttcatttttccttttcgtcaacctgttacccaatagcaaatgaagtttttatgtgtgtgtgtgtgtgtgaatttccatgaaaatgaaacgggcttagaatcccggtgtattatgggtcgggtcgtaaccgggcaatgacgcaggatctgacgtaaaactcccaagaatttttttaaaaagtctccggaaaataaaatcaaagttcattaacttaaaaagaaaaaacaaaatcggtccacgtcccaaaccctttttataggagagtcttatgttctggcagaagacttcacagactctttcttaatctctctctctttcaaccaaacccctaaacaaaaaaaaaatacattttctgatctctctaaaaatctttctccttcgttaatctcgtgatctctttctttttctatat

SEQ ID NO: 4692 - DNA, 572 bp, Arabidopsis thaliana
gtgttggatctccattttggctagtgtttatgtttttcttttctacctatgtagtagtaactgcaataacccaatctagtaagttagtacagttttaggtatgtttttcaataaatggcaagaatatctggtttagttattccataggtttcaaatacagtaatagtttgaaattgattttaaaatttcatctatcaattttcctaagaaaaatcagtttgagaccattgttcttcacttcttttgttctagtgtttattattaaaaacaaaaatctattttaatattaaagtttagatctatgattactgttgtcagactatgattgcgatttagattcgataggaatatttcatatttaattcggtttggtttccgaatcttaaattgagcaaatcatacttctaccctattccagttccgtgagactcaagtataatatctatgtaatgcaaaatgaattacgagtttaatattttaacatccatgaatttttgtaatgcttggttacagtatctgatacgttttttatatctatttcttttgatatttgaaaggcttgcaacgaggca

SEQ ID NO: 4693 - DNA, 2000 bp, Arabidopsis thaliana
cgagaatgtagtcagtctgataaattgttgtaggttgggaggtgcatattttccctcctttcaaatttcagtttcttgacttcattaatgttaatataaataaacatatactgcatgataaaaatgttaatttaactgtaaatgtgaatgcaaatctgaatgtaagccatatgttttaaatattgtctacctaaacagagaaatgaattagtagcccaacctagccataacaaataaataatgaagaaggtcttcttccgccgaagataccaaaaatatattatcttctatttcaaaaagtatcccatttgtttctaatttctatggtacaatgtagttgttgaattgtaattttctcaatgttaatttcgttatctacgtaagcattgtcaactatttacatagtacatacaagtgatagttatatattagctcttccataatttttaattcttatcaatatgaaaatattgacaaatttatacaaatctgcatagaaaacacatacaaaacaaatatgaaacaatgttaaaaaaaaaaaaaaatatgaaacattttttctaatacacctgaaaactaaaataaggggtaaatatattagaggtaagcgaaaaatctactacaatctaaaccgagatcatcccaatggtataattaaagtctaaaatctaaatcgaaggagcaaagtattttgtaaggcacacgtgaaagaaagtaactacgggagtgattaataaaaacgggccaatgatttaacacttttatggcataattaaaccaagaagggaccaaataaatatgacatattgatacaaaaaggaatgtgaagaaaatctccggttctacgaaaaggacttccactactctttcccacacgctccagaccactgtttgctttcctctgattaaccaatctcaattaaactactaatttataattcaagataattagataaccaatcttaaaatttggaatcttcttccctcacttgatattacaaaaaaaaaactgatttatcatacggttaattcaagaaaacagcaaaaaaattgcactataatgcaaaacatcaattaattacattcgattaaaaaatcatcattgaatctaaaatggcctcaaatctattgagcatttgtcatgtgcctaaaatggttcaggagttttacatctaatcacataaaaagcaaacaataaccaaaaaaattgcattttagcaaatcaaatacttatatatatacgtatgattaagcgtcatgactttaaaacctctgtaaaattttgatttatttttcgatgcttttattttttaaccaatagtaataaagtccaaatcttaaatacgaaaaaatgtttctttctaagcgaccaacaaaatggtccaaatcacagaaaatgttccataatccaggcccattaagctaatcaccaagtaatacattacacgtcaccaattaatacattacacgtacggccttctctcttcacgagtaatatgcaaacaaacgtacattagctgtaatgtactcactcatgcaacgtcttaacctgccacgtattacgtaattacaccactccttgttcctaacctacgcatttcactttagcgcatgttagtcaaaaaacacaaacataaactacaaataaaaaaactcaaaacaaaacccaatgaacgaacggaccagccccgtctcgattgatggaacagtgacaacagtcccgttttctcgggcataacggaaacggtaaccgtctctctgtttcatttgcaacaacaccatttttataaataaaaacacatttaaataaaaaattattaaaacctcaaaaaatctctgtttcttgtttatatatccaaacaaatgaatgtgttaaaccttcactcttctctccacacaaaattcaaaaacctcacatttcacttctctcttctcgcttcttctagatctcaccggtttatctagctccggtttgattcatctccggttatggggagaga

SEQ ID NO: 4694 - DNA, 1224 bp, Arabidopsis thaliana
atcgatgaatctctgtctctctctgggtgtgtgtggttcttctcaagataaaatgaaaaaaaaaacaatctgtggtggctataatttgcgaaaacctaattttctttacaaataacggtcaataactaacttttaccgctccatttttgtatttttgttcaaataattagttgatgaatattataggattttgaataagattctgtaaaataatacttttttgcagatataaaaaactatcatcatccaataaagacagattttttataagaaaaaaatcaagcaatcaagcatttccaaaactatgatccattaaatgctctaaacttattgtaatgattttggtaggggttgatattcgattttctatcacattaattttatttaaaatccttgtgtttcatatatataaagggaagttagtataagatggtgacaaatattaaaagggcgtggtccatgaattcatcatatcttataaaaggattcagtgtgtgtgttaggtggtgataaacacaaattagtctttagatcatatgcaacttgatgagtggtggtagatttggttggtgaaggctttttttgtcattagcccaatttccggacttccctttaaattttttttttgtcatcatccaaattttgataagtggcatcaaatttcgaatgttttaaatgagctacctaaaaaagaaatattatacgtaacgtggcataaattaagttaacaaacataaatattggaatatatttttatactttccaaattctggtttttcaaccttttgttttgttttgagctttgtaaatcaacaaccaaaagtttttaaatgttatctagtatctaccaaattttggatcggttcaatcaaattgaatcattctttactttttagcatcatctattataaaatttattttttacatgaaaaacgtttcctttaacggtggccaaaagagacaaaagcttccacgtcgcctgaaaaatatctcaaagcacacaatttacataaatacccctacgacggccaacaaccctctttttggtacactagtgttctgtctgcaaaacaaaaaactctgaaaagtcgaaaccaaccctctcccttataaataccttcttctctttccacattgtcttctctctcctcacatcaaaaccgcctccatttctcattctctctctctctaaaaaaccaaatccagagtcagagaaaatctgtg

SEQ ID NO: 4695 - DNA, 932 bp, Arabidopsis thaliana
agttttgcaacattgtggacaaagagtgtcaacagttttcagacaaagaataaaatccaacatgttcctgatttctactgagtcagtaactgttagctttcttcaaattttctcttacaattcaagcctgaatgttatctgtttaggtccctagaaaaactttgctattttgcgaggtaaatcatcaatacgagcaaagatcagaaaaaatatgtattggttagtctctttgtatacctcatttatctttgttgtagttcagtaacagagactggttgttgctgcttctgtcactttctttgatctcttctactttaaatgttatcaaggattcaagttcgacattcaagtaactagtgaaaacaataaacacatagagtcttaatgagtcaagctgggacctttaagaggataagaggattgtgttggaggaaaaaactagtttttttctttgtttccaaaattcacttagaaattctcaatttatatatccaaactcaatttgtacacaacaggtcctcctccagataagaggacaagttacaactacttagcacaagtctcacctacctcaccactttagaaaaaaataacaaaatgttttaaatgttgccaaaacaacaatactttaagagcatgggtatcaaaaacttgtgaattttctgaacggacagtgttcaaagagcatctttaattttttttgaagtatagttaatctttttgttaaagagttaaattagcttaaatataaatatttcaatcataatgaaacaatcacttggctcataatacaaatatttcaatcataataacaaaattatgtttactaatttaacaaaacgaaaaagagaacaaatactgtagtagcgatctttttgatccaaacaaaaaaaatcaaaccaaaaaatcgtagcgatctttgtttgactgag

SEQ ID NO: 4696 - DNA, 1109 bp, Arabidopsis thaliana
accagtcatacgtagcgcaatgatattgaacatcatgtaaaagaaatgttttaatcttgagttttagtatatgttttcaatgattttttttctctctctttgtacgtaatagtttgattcttctgatcatgaatgtcatgtatccgcattaatgtatatagttataaatttctattatcatttatttattttaggttgcgctttatttattctcaattttcccatacgaattttttgtctttatatttatcacaaaaaaagagtttgctctttaaaaaactatactaatgtaatttttttattttattttctctatcttaatcggatattaatccgactcttcttcttcccaaaaattaatattagtttcaaatccaaagcaacccacctcattcaactttccttcgattttcttcaaatttccagtttccacttgctttcattgcttctttcccgccgtttctagatcttcaatcgagaaagggatttgcaacttttcacacaaaaatcttagattaattgttattaataacttgttcatcaaaccactaaaaatcccgtgtcatcttcgacttcttggttaaaattcaataaagagtgtaacttttcattgctataacttaataatttgtttgtgagaagagaactctagtcttacagggaccaacaccaacaatcaaaatttagataatgaagaatagttgctgatgcatgattaagattgaatttatcaacaaaagataagtgttcattatacaacacgtgattaattgcatggtgtattaaggcccattaacgaagtccatggtaaaatgaaacggcatggcgttcactaccccacctaatgaactgcatgtcgtctcaaccatcaacatagaagcttcttgaagccacctgagaaatctggtagcgacactcttgaaagacacgttataaagaaacggaaagaagaaacctgaaatttcaagaaacttgcagagctttctatctcttatcctcttctctaccatcatttctccctataaatacgccaacgcacataagtgtttgcattcgaagagagttctagcaaaacaaaacaaaacagagcaaacagagtaagcgaaacg

SEQ ID NO: 4697 - DNA, 2000 bp, Arabidopsis thaliana
taggttaaggtttcgctttcaggagaagaaaagcgaaatattcaagtggcagttggaggtgctaagtttttgattcgtttagtttaatatgaatgttagtatataaatgttatcacgttcatgttttcatcacaatcaatcgtggttttgcctcaccattttatttttgttttggaaaatgtatattctaattactctgaatataactacatattgatgaaaactcgtcatatttgacactgagattatatataccatggaaattttgattagtagaaaaaagttgcgcctatttaaaattaattcgtaggctcatataggataacgattgaaggtcataaatcagattaattactaccacttggttggataaattattttcatcacattgtcggtagagaatatcacattgtacaaactaaaaaacgtattattttttctcatataaccaaatctagaaagtgtaatttggttatagcttagatgtcgtttagctaataaatatagaaataaaataatagagaaaggagagttagtgatgaatgattgaaatggtgaatgataattggagaagtgggccacgtgagagaagcatgtacttttggaaagtgggtcatttcgaagctcttcctgtctccatccacatgaagttggcattcttgtgtctttacggcctaagtttgcgtttctacctcttgagaaatgaatcttgccttcttgtttagtgactggtacggatctaatagtaacatgacaccatctcatatttctgaattggacgtctttgaattgaataccataacctaggttatagtctacacctacaatattacgtgccgatagatcaacatgcatgatccgtatagtttagtgatctcgttacgtcgttatatcaattggtgaaaatcatcaagtgtttttttaggagtgatgaattactggtacataaattttacgtttcgtttagattttggaagaccttgacgacacagtggtagatgttggtaaatggataacgcatgcaacaaagaaataacgatacaacaacaataatgatgacttaaaagaagaataaaataaataaaagtggcagtcataattcataaaagcctaagctaggaaattcttatggtagaccagaagggacaccttcgatgagtaaaatctgccgcaccacaatcttacatcattctcatcccctaaacttggacctcctccattaataaataagaaagctgcaaacgttaatcttctaattgtgattttgttacaagttttatagattctttgttctatctagctacatatatttcatacatttcactaatttacaaatatgtaagaatgtaatcaatgtaatcgactaagaatacatcaaacattaccaaatttgattgacatttacctctgtctattcgtcctcaacattattatcccatacgttcatacaaattgacattttacacttaattttgaatatcatgatcaatactctctcgcatgggatacttaatcaattgttggattaaatattctttcgcatctttgtgaacgcaattagtgggtggtttgggttccacctttggatcctgcctttattccacataaagtagatcactggtcatactcatatccttacggacaataaactattgttattggtattgccgtattattgtaattctattcataggtctacttccaaatctttgagatttttttttcattggggaagtaagatagatctcgcaatttatgctcgtaagctaacattatttgggccttatatgggctttatgttaaactgatagttaataatggacctccaatagttattctgttaaccgttacttcccgttagattatgacatcctcactcaaccaatacttaaacgccacatgtcgtcacatcagccacgaccttaaaaaaaaatcaattcctctctcttaaaacaaagaagaaaaaaacagagaagaagaagaaaaaatctatctccgcc

SEQ ID NO: 4698 - DNA, 2000 bp, Arabidopsis thaliana
gactgttaatcgcagtctatacagtcatctatgcgttatggaacgaccaaaacaatatggtcttcaacaatcttctcatcatcgtagaagtttctcttcaaaattgttgttttgattggcgaatcaatattatttgtattgcaagacgagaaattaccaaaggatagttaatctagacttcgaaacgaattatgtgaagttcatcaaattgataacaatttatattgcttaagagcctattatgtctcgcgttttatttgttaagattgattttttagctagttcttttttttttgtgcaaccgtttagctagttcaatttgtagtatatacaaggtttattatatgttttgccctactgttttaatgtattggccaatgaaaaaattataaaatatattaataaaaggtaaaacagaaaatttaatagttttcttaatttgtgtggaaaaacattaaacgacatgtaattcaaatggatggagtatataagagaaacaaatatatttgacaaatgatattagagtatcggtaaaattgacttcgtagacgtacataacgacctttaccatacccgaaaagtcaagtgtacagtttaaacaattaatgcaccgaatggagtttcatgctaacttaatattttattttgattcatattatattatttatagttataatgtgattcatatatattaaaaagtgataaatgaatatatacatatatatagtgatattttcatattattacaaacatattcctctctatataactatattttgtaatttgttttcaattttacatacattagataaaaaatagacactaaataaattcgcgatccttcattttttttttgttcacttaaagattaactttcttaaaataagattgcaaaatattgagatgaacgacgtttctggtacatgaagccggcatgacctaattctccggaaattaagttgacgtaaagatatatgaaaacaaagccttaacaaggaaagcaaagaagatgaaatgagagagtcagagaaattcacaagactcacacatgggaacgggtgacatgggagatctagtgataaatgtattttggacgttttgtggatattttcaacccacttttttttttttttttttttttttcttcaatattttcaacccacttaatactacagttttgctacaagccatatctctttttaactatttttaaaatctctggtatattctgtgattactctacagtttttagttacctaatattttttttttgaagtaaaagcagaacccaaaaacaccatcacaaagcacaaatctttgaaaacttctgagatagagacaaaacaaaagttgggtcctataaattttcattcatttttcatctttaaaattcatttatttcttcttttaaattattaattaaaactttaaaagttggaaaattcttcaaaaccgtacaactatatttgtgtggacctgaagccaaatgtctctctccattggccattttaccttctacacattcccactggccaaattcgaagttcattctctctcaaatcactttgcccaaatcttcctttttcccatatttgatttcttctttaaataaagcaaaaaagatttcatctttctatttattctctttataaattggaacctactttgcttcttcttcagtctccacacttatcttatttttgccagtcttctctgtggatgaagcagagtttttagtcaatcaaaagtttgaagctttccttcatgggtttctgatttgtctactaaagttttgatttttttaatttgggtattaataaaaaaagtggggagtgacacaagaagcagtatagtcattagttttccactaagcaaagcacccaaaagttcaccaacaacaaaggcctaatatgtgtctttgtttatgatttgggatcatctgaaacaagatgcgaggagatagcttctcaatgagtattgagaatcttcctgattctcca

SEQ ID NO: 4699 - DNA, 1757 bp, Arabidopsis thaliana
aatgttaaatggtaaacagagaatatagctctcctctctctctttgtacataaagaatgtattaagcaaaacataagataagaagcagctaagaagtcaaaaggcttcttcctctggttacataataaataaggcccttatctttatcaaattttcgtttaacttatttttataatttcaagtgaagatgttttataaattgtttgcatttgtgaatatttttgtgggagaagaaaaaagtctttcacttggtggttgtgtaataattgctttcttgtttcgtctattttacatttccaaattgttccaaagataggaccactccacatcatttctattttctttcattttgattttgattttatttattttcaatccataatgtttgggacaatttgaaccatacatcttttcaaatagaaaactatagtcattttcgcaaataattttctaggagttcagaatccgataagcccctataaagtatcttcagcttcgacctattgtgctattttgcgtgttttatattcattttctcgtttatttattatgagttggaaaggatataataaactttatgtcatataatcaataactcaaccgttgaagtaattattgaattatttgatgaatgaactaatggaaatttctagttttagtcacaacttgctaatgaaggtataatcattaacaattttgaataagaagatgagccaaatgagtattaagttagtacttgcataaatagttatatttgttcctttatttatacattgatactttgtaaaaagtagtcaaaattgaaatggttcgattcattgcattacctaaataagagtcaacagagtaataaaagcattcgttaggtgtagattagaaaaaagcttacttataaagaaataaaaatgaagaaaattaaaagagaagtaagtttttgggagtgagtggtggtctagttggaaaaagcaagccaccctaaaactcatcataacatgtgccaattgctactacatatatacatcatccttgtcttttcattctctattacaacatgcattttaagccaatagctacgcagataaaatataaaccgttaaaaaagattcatgaaaattgataacacaacatgattgaggttgaactaaatggatctcttgatttttaatagtactaatcgtgctgtcaataaccaattactgaattttgtagtgacgcactgattttctacattagctagattactctgttaggaggaatagtttttactttaatttgagtacaatttttaaatttattttttcatgaaataaattggttattataaaaatttatcctttgagaacattcaatatgttaagcaattttgcaagaaccccattttaagttaataatatatcaaaaatggttgtgcatgcagaaaatttatgaaaaaataataattcatatgcatttaaatatttagtacatagttttataaatatagttaaaaaaaagttttggctgaaccgatatttctaactaacttgcttataacaagttttattcaattagtaaatttgattccaaatcacctttatcaactcttaaagtatatattaagtttaatgattgtccacgaaataattatgtatattgtatacaaaaatatataacaagaaaggtaaacaagagaactcactgtagaaacaaagacttataaaaagcttgaggcttgaagaataagttgatcattctttcttggcgaccttaaatacaaa

SEQ ID NO: 4700 - DNA, 2000 bp, Arabidopsis thaliana
ctcttttctattttcctttccttgacaaaacttgcgaatcgttttgatgttccatacgtcttttgccatcattcatacataagtaccaaccaactattattaaacttttatttgttaattatacacaatattgactatatatattattatttttaccacaaaaaaaatttaaaatttagactatatagtaccaaccaatatagtattaatttttttttattttttacaaaaaccaatgaataaatttgattttccgaatgtggtttcttaattaaatttatattatttcagttccaatatttatatatatagataataaaaacaaaagagataaaagaagagatattggaaacaaaagaaaatgaataattgagagaacacaaaagaggaagaaagagagtggagaagagaagagaagagaagagagcaacttcctccattttcttttggcttcctctctccttctcggtttgttttgtctgtacctgagagagtttcccctaacaaaaaaagactcttttttcctcaaaatccatttcgcttccgacgccattctcagtcggtgtgaacgcgtgagagaaagagagagatttggcttactttatctccggcgggcatctttttccggcggagtttccgatgtatctactctagctaagctcagctcttaactgttacaggtctctctctctctctctctctctcttcccccgagtaaaaaagccacaaaatgtctgaatcatttagctctgatctcactttccgatgctttttacctattttctcgtttcgatttctttgtttgcttttcactgttcttacttcaattagattctgatccctctttttaccctttctctctctctctttctctgcttttgcttttactgtttccttacaattgtgattgtattgagctaattttggtcggattcatttactcttctctttgtcaatttgcttgtttttgttaaagatgtgacatttattactaaaggtttcttctttttgggggaaacaaatttgagttcatagatagacttactagaggagtgttgtatcactgatgctggaatctggttaatgtaggcagatccacagtgcctgttgattgtttcttcctatcatcaatctcggaatttgagggggtcttattattaagggtgagtcaattttgatttgtaattttcacaaggagtttgtgttcagacttcagagcataaaaagtgactggcttgattgtgataggtcatgtgaaaaaatggtaactggttcatcttatcttttgttcagtcactataaagtgtccctctgattacagaatcttattctcctttctttttttccttacaaagttcttgttttgttatgcttgtcctgttcctctttgctgctagaaatattctcttcttctactctctcttcacttttcctggatcttttaggtttaaattttgaagcttgcagagctggaaagtttcttcattaggaatctttgcttgttagtttcgtgtcacctcagataataactaaatagctgtgaaactgcagggaccataatgaatgaactccgaggcagaaaggctcaaaagattgaaagtccagttccaggatgcttagggaagatggttaacctatttgatctaggaattgctgttaatgggaacaagttgcttacagataaaccacatcttgatggtaatcactagttccctctgtaattgctttgttcactagtcgaagctttctgttatgtttctgaactgagtaggatgtcctagtatccacctgtgttattgacacgaggtagtttcatggcaggatcctctctgtcaagaagtcgatctgatgtgactcgaatgccaggcccttcttataaaggccattcagaagctgaattggtacgtttggttaaataattagaaatagtatgcatgctagcaacagcgattttaatattcagaagctgaagtctattgcctgcactgtttgcacagatt

SEQ ID NO: 4701 - DNA, 2000 bp, Arabidopsis thaliana
gttgtaattaacgacatggaggaagttactcacccaatgcaaattttgtcacccttgtgtcctttgtaggtaaatcattattcagctgggaacaatggatcaccatctgctgcagaggcctctcatattaagtctcccatattcagatccttgcattcaattgatgttagtctccattgcttgaacattgtttttggtcgtattgcactatatcttgttactgttgtgttatcacaaataataagaaaaatctggtttcaatttttatgtaggaagagaagggtttgaagaaaccggttagtctccattgattccacatatgttcttggtcgtatttgcagtatatctttatcactgttaattcacacataataagataaatcttgttttgaatatcttttgtaggaagaaatgtgtttgaagcaaacggggatggcttcaatatgattcaagaagggtagtgtgaccatttgtgcatctaagcaaacgagttgtctgttgaggtttagttatcggattttgaagccgataaaaatgctattcatcagtgttccataagcgagggagaattatgaagagtcgtcgtgtccatacaaagcagagcaagaagattacataacacctacaaaaacatgagattctatatgttgaggacaagtaagcactgtttctactttgctatttcattatttgttttgtctgaaaatatgttatttttggggatatatggtttagaatagagtcggaatctacttgatgcatcatccatcatataaaattctttccgagttttttcttgcgtgtaaatggaatggagatactttctttttatgtttttggtttgcaagtggagatagtaaattaaaagatttcggcgttgatatgtgtcgtccttgttatagagtaaaacgatcaggacatgtaaccaaatgggattgtagtaataccgtcactacatcacgagccgttcatgaaattccggtagtagaattcatccgtaatttcaacaaaactccatatattttggatgatctagagagagcacctttgtggacaatgttattttttggtggtaatcataaataagaaacttcctatccaataatttaacatcaaaaaggcccatctaataaaagtatacttaaaagcccacaaaaagaatccaagtacacgtgttgatgtttgtagaaaagtctactggaattaatgagctgattaaaaaaaaggagcagctaattaagaataagacccacagagagaaaagaaatgagaaacccagaaggatctggaagaagaggaggatccttttcattttttctttcttggataaactctctcctatctttttttttttcttttcttcttctacttttctaatttcttacgacaattctcctcctttcgtacataaaacaaagaaaccctctctttttctcatcttcttcaattttcaaaactcaaaatccttcttcatcgtcgctacatttttctgtgcttctcggtttctgctatcgaacaacaagactcaaaaggtttgctaatttctgttacttttatcgtttctttaaaacggctgatttatggttagggtttcaagatggaacgcagattcttctttcgattttgaatccgaccaaacaaaagctcatatctttgaatcgatgactttgttgtaaacttttacgatttcgtctactttgataaatgttctggtttgcgattgacgatttcaaaacccttttcatttctcttctataaagtcattttcttttattgacattttgatattattgggtttttcagtgtcttgatgattgggttttattctacgctttgatgttccttattcgctcttaggggttcgatgaacttcattagctgacagatgtatattagtctcttcaacgagatttactcatttagctacaagttcttattctgtgttattttattttttttaattattctttgtggttatttctaggtagaaagaatcggac

SEQ ID NO: 4702 - DNA, 890 bp, Arabidopsis thaliana
aataccttgtaaagctttattggtttcttttgattttcagacatctggtgttagatagtattgtaaggattaaagacatatttgtgtgttttttctttgattactataagtactgagagaatttgcagaaaatgagtacttaatttgcagacatgaaatctgtaaatgggcttcatttctgcaaatgggctttattagctgaaatgggtttcatagttttatgggttctcaaatgacccgacccgggttggaagatatagaaactatacactggttggcaaatgggaacgttcgattaaaaattcggtaactactacgacgtgacttgtctcttctccgttgaaaagccatcgacagttatgtatgagtgtatcatttatcaacttgaaagcaatttcagtttttaaaataatccaaatactaataaaccagaaattaacccatcatcaaagcattaataatcttcattaccatttgaaaccgaaacttgtatcacaattaaataacgatcataaaattagacgtttttttttctctatctccattttcccgggggaaaaaagatcggatttttgttctaatgtcattgtcaaaatattattcgacagatcacaaaaaaggtgaccgtttttttttttttttttttttggcaaaaaaaaaggtgacctttttattttgacattgatagtatgaattatggggtctgatgctagaagttcttacatggcgggccagacaaagtcaatgccggcaacaacggactcctacacataaattttttaattcaccaattgtttctcttctataattagccctcatcactcaatttctcaatctcagattataattccacaaacgaacaagaagaagaagaagaacacaagataaca

SEQ ID NO: 4703 - DNA, 2000 bp, Arabidopsis thaliana
ctttgtaactgagttgaatatttgtaacagcagatatcgcattttgatacttgtcctctcgaaattgatgtttactgacgcacgattattgggaatttgggacttagtggtgtaccaatagcatctcagctttcatggttacaaagaggccagtgaaagaggcttggtcaaccgcaattatgatccgttacttgcactgactaccaccgatccaccgccgtaactctttaaatcttaatgcaatactaattcgaattacatgtcgaggtcttaaaacatgataaatggttgtttaaagtaaaaaaagaaaagaaacaataaataaaacaaacggtgatggaaggagggacgtacgatcgtagtcgtagagactgccaaataaataatggaccactattatgtggttcaagaactatatccttttcttagattccgaatcttaacttgtgtttcttgccttgtttggttttttttttgtttattttgtagttttgtctcataaaataacgaacaaaaagcaatggtctaaatatttctcaatatatgtatttaaaaattatatcatagtttcgcaaaaaaacgaccgaacgaacgatggtagtcatttgcccaaattgagcctcgtagtagttgctacgaccacacccccgtcccatgaataaacacgaccatgtaaatattatctataaagacaacataaatttacaaattaatgttgaacagaaaaagtcaaaaagaaaatttcgttaatataataataatattctatgataatataaaacgtggcataacacatgacttcacatgacatcataagaagacatatgccacatgaactcttcatcgcctccatccttttagtctcgtttacatgcagcaaactacgatctacgattatatacaatgaaattcaaattcataatcaattggcattaaacatacgtatatcataattcataaggttaactaggtttagcaaatgttattctctttggataaacgtttagcaattgtttatctcaaatttaattgaaaatacttgtaagacacagttacaattagttctcaatttccaatctacacaagatttaaatctttctttagttcattctgatctatttttctctcaaagaaaatgtagtgctccaacttttctcccaagactaataaaaattttcttaattgcatgcaaaaatattttttccaactttaatcttatcaaacttagatctcattttatcttccgaataagatttttgttttggtcctttgcctaatcaaactaactaattagattagaagaaaaatacaattagacaaaataatatcgatgaaaaaataaaatccacaagaaaggacctaagaaatttcacgtccgaatcacaaccacagaaaaaaagagagaaatattagtatataattaaaattttgtcgtctgtcttctctggttcactcatctcctatctatttaaagcccattcgatatcctaaaacactgtatcatcaaaaaacacctcaaagaattattcattcaggcatcttctcaaatttttgtttgtgaaaaaaacccacatcaaaagatctctcatttattcgtttcgtttctgctgttttgagtgtcgggttcgttttagctgtaatctttttttccggcgttcgatttgaaaaaatccggggaacaggtgatcggaatcacggctatacacgggatatcacggggtgttagctcacatgtccatattgtccgacagaagggttgtttaatcgaaactaatcctttgccgcacggaggacgtggagctctgccgtctgaaggcggcagcccttccgatctcctctttctcgccggtggcggttccagctttaacttcttttcctttaggttttaggagttagggtttgttagtgttttttccttcttctttttttggtgctcttgaatcgcttttttcttgggggaagttttttcttttgctcttcgaaatttgtcttttttgaga

SEQ ID NO: 4704 - DNA, 2000 bp, Arabidopsis thaliana
ttagcaaaaaatacattactttgtagagacgatatttgtttatgttaactatattttttccctatcaaagtgtagtgtttatgaggtattttggatcatcctagtaatctagctagctacttctataatatacgaagtaccgaacatttgataatgatgtttcaatttcatacgtttgttcctagttcgtgttaataatttcgaacggacggtctattactgtatatatagtcgaatcttatacgaaaacattatggagaaaaaaaagtcatgacacaataatcccttctttttatctatctattaaaagaaaagttggtagagataaacaagtaaatgctaaaatgaattttctataaagaaacaaaaagaaatacgtttacgtatcgataatgtctatgcactatgaaaatatatatatttggttatgcatgaaaagatgtttggaaatcccaaatttttttaaaggtttttcgtacttctaactatgaaaacgtgataatcaatgtgcattagcatttttttaacgctcatataagtttccatagctaactaaaccagtttctgtcagttttgtataaatttgtcgtcatttgtttttttaaaaaagctttgtgtcaacaaaaaaaaaagctataaaaaaccaacactttttaacacagaacaattacatagtatataaatcttgaaaaacttgaaactacctagtaataaggagattatggctaaaatatagccttgtccatcgaattgttctgtttttgtaaggttggatccaaagtccaaactgagttatacgtattgtaactgtgtaacattgtcatcaagatcatatcttagtgataacaagaaatattattagtatagaatgatgactaatatatgatcttatctctatacaaacacataataacaattaaaaacgtaatctttaatgccaacacacaaagttgacactatcttataccataattactagtaaattatcctactaatatttgtatagaataacgataaataagcaaaataatcacctatttttagtgtggtaggtgaaccactcaaatctcttcaaaataatcaggacgtaatacttttctcttacgccttcaatgccgtaccacactttttaaatctccattcacacttttttcttattataatctctattcacacttaaaaatcgttattttctatgatgttaattttaaatatatttctgtaaaatattccagtttatgtactagtgattatatatgtaaatttgtcacagaaaaaaaaaatccaataaatgacagaaatataatgaaataaaaacatatttgaatattgtactagtattagtgtattactatgtcttttattagcgtaatatctatgatactaaaactacaactacaactataactccgaagattatggtatggtactactaagtactaagtaaaataattctaaaataatatatagaaatgaatgattaaaatgatattgtagtattattagtgtcgacacgagttttgatttgactcttgtgtagacgacaagtggggaacgaatgtgatatttttatccctgaaatggttctttcttatgttcgttaaatgcgaaatcattactcgtgtgcttccataaacagagttctcacaccaatacaaaagagaccatcaccgtgagaaagagaagaagaacaaaaaaagttagccatggcatcaagaagagtttcttcgctgctctctcgctctttcatgtcctcctcacgttctatcttctctcttagaggtatctaaatgcgatccgatccatttgtagagccattgcttctctgtcatagttatcttgataatgatcgagatcgttctgttttcattgtctctgttaactttcatacggatcaatgatctccgagtttttcggattttgtggttacttgtcgatggatttgatgatcttggtctcatttagatcgaatctatgcgttcttgtttgtttctttaggc

SEQ ID NO: 4705 - DNA, 2000 bp, Arabidopsis thaliana
tcaaagataatgcattatccgtgcgattagcctcttcctaaaatagcgaccaacgtctttttatttcgttaagttatttataattattggtccctttggctttttaatcttattgttaatattagtactatttaatcaaggcccacatgtcgagcgacccaacgccatgaccgaatttatattctatcaaatatgcatatatcatattgtttataaatggtcttggtgttgaaacataaatgtatatacagttgatgcattcgtttaaaaaaattccagagtcctattgtggtaaagaaatagactatatataatatagtgaaaactagtgttgtatgtctataacttcaaattagtctatttcagttttgacaaatcgttatccaataaacaaaatttagtaatcataccaaaaatgtagaaacctaattcaatctgcactgcggcataccatttaaaccccgaatgattaaactttattcattggtgattttttttttcttagtttgaaaatatggtttacctaaacaacggaaaacaaagaagaataaagttttgatgaattattgcaaacacaactacacaaggaacaacaagtaggagattaaagtctcgaaaccatattaaaaggagattggtgacataagtgctctgtaattaccgttgtttgtaaaaagaacgaattttcaggaaaaaaataaaatgaattaaatggagcaagttggggagggtacagcacgagcgacgatcatgaagccaattaccaaatgaaattgtgatttagggtgctgatattcataaacttgggttaagtcgttgtttaaaattgtgttttggctgttagcgatgaattatagtaaaacaagaaagagttctagtaaaaaacaaaaattgcttagtactaataaatttcacaagaccattcacactatacaacaataatccttcgttgccagcagtctaatgggactgtgttataggttaatctctctttcacggactattaatttttggctcaacctcaatgtaatttatttaaattatatttcaacgcatacacgtgaatttatacatcttttcataggatttgcaattccggattctcatccgtcctaggaggttgtatatgtatattattggtaactacagcattaaacaactttaacactaagtacgatgatattatatgtacatgtacgtatgctatagattgatataagaaaaaagtaaagagagagcggatgattgttgattgaactaattaacaatagtgtattaggtaggcttgtatccgacagtcaacttaaacttcatagttgaaaccaataaaaccagaagaaaaaaaatttatatactaatcataatcagcatgatgttagacgatttgatatctaactttcttcgttatgatagagaaataatattcgcaataaatcacatataaaaaaaattactttacgtcatagattatcaacttgcctccaaacacaacaacatgatcccctacgctacaatacataatatgaaaaataaattaatcgttgattaacttaaagtcactccgttaataacgttataagcaaagcttattagtttttttgaccgtcattatcgacgaccaaacaaagaaagagtcccaacaaattatgccacgtaagtccagaacgacgcctatgaaaccaataagacaaaaattcaaaaaccaaaacatccgtgaaaactcttacgtggcggtgacatgtgggtcccttatgtctccattaactaacataagcttattgtcgactgtaccttttgtcccccgtctcggctacaaccctgtgacaaacaaagatcaagtcaaaatatctaacctaaagtactctcgtccacgtggacattgctgacgtggaacttctcccttctataaatacaggcttctcttcgccgaattatactcatcaaacgagtaaaacatttgctaatattaaacactttttcttttagaaaaaaaaacaaat

SEQ ID NO: 4706 - DNA, 1299 bp, Arabidopsis thaliana
tacaacaacaaggaaaactcaaaaatcaattttttttttgcaatcatcaagagattaataacaaaagagagatagagagagggaatgtacggaagaagagggtttgatgttggatatgatgagatgctggaaatgagagtaatccttgaaccattcatagtgttcttcagaagagaatctctcgtccctgcattcttccaagacattcagaaacacaggaaagagagagggagactacttgtagctgaatgcaattcatgattaccagtagtgaggatcgaggtaggttaaagcagaaggaggaccaacggaatttggattctccatagctggacttgctcgattctcctccttatcagctcagccaataaaccctaaaccccttttcactaatcacactagttaactaactcttatggaattggtaacagttgacttgatcttggcataaactagcttaagagttaagggggcttgttttgttataacatatgggcctataaaagcagccgcatttcttaagcccatgtgattttcttacatctacaagtctctgttttttttttttattcacgtcttaacggattacttttgtccaaatcatttaagatcagcagacttattgcctgtgacgattatcaattcattctatatttttccttgttttgtacgacacttaacctatccaatgatttgcacacacaaaaaaaaaaaaaccctatccaatgactacattttctatgtatgtatgttattgtcaatgaaaaatatgccattctcaaaaatgaatattcttgtttttattacaatttttattaatatccatgatacatgtgtagttgacaaggtgacaactcagaatcttatattcacaccaatcacacatcattaaagaaaagagtttaaccataaatttgcgacttcaagagactttcactttcgcgacccaatttttttttttttgtggcgtaggtacgctcttttagtaggatgtctcttcccattattttctcaccaaatatgaaatcaaatcccataaaaaaaataagacataaaaaattacacatgtccaattccaagtggttcgttgcattttacactaattcccaaatacatttccttgtcaattatccaaaaacatattaattcaatttttttttttttttttgacatctctattttttttttttattataaatgtggaagaggctctgagataactcgtggaccaaaatcgtccattgaagtgaacagtcagcatcgttttgcttgcttgtgcgtttctctcgaactctctcc

SEQ ID NO: 4707 - DNA, 2000 bp, Arabidopsis thaliana
aaaggtaaaatatatcactaatattctttaaaaataataattgtttttgactttaatgtgatgacattctttgtaaattcttactttactaacacaaaagtactttaaaaagtacttcaaaaattttaatatatataatgttattttttggtaaaaattattataaataaatatttaatttaatcataatttgggattgatatacttgtgtttttaactaactattttttattttaataacctaaatttaggcatttgttaatattttttgaatctgcaatatcaacttaatacatgtacaatttatttttgccaaaaaagagcaaaattatttagtacaattgaaacgaaaaatgttgattgagaaataattagggtttcaaattttattacgcaattatttttttaatgaaaatattaaagcatatattgtaatataagatttgattcattttattaactgaaaataaatgatgtaaaacgaaaaatcagggtgattaatgctaattggaaagatttaaatgttttttttttttttaatttcataaattttagtaacataatagattttatatttatatttaaaaataagtttagtaaaataataaatgtcaatggcatgccatagtaaataagtgctaagtgaagatttatttgttaaagtggctgcaaaaatgtatatatagatagttattgtttctaaaaaaaaaagcaattaaaaaaataacgaaatacttattttccttaactgaaagaaataagtaattttatgttgctgggcctttatatgagttttattatgctgttgtaactttaccatggttgggttaaaatgaaagaatgaaaaaaaaaaaaaaaaagtaaattaattgtcgactcatttttcataaaaggtaatttcagttgagtaaaccaaaataaaccaaaagatatacgaagattcaacagtacacccatccacgcgcggctgcgttgaatactatacggggggtgtcaacaggtcgacctaccaaaaacaatgcatctaagcagttgcaaagacacactaagcaaatctttcacgtgcaataaattatacttacgtcacagccatcagtatatcctttcaaatattcctcctcacaattgatgtatttacatgtgtgtaagttgacacaaacaaatcacttgccctgaaaactaaaactctcgagttttttcaaaaagaaagtccaattcaatttaaatttgaagtcttcaatttgttttcaaatactaaaaagtgcggctctccctctagtgtatggcctcgtttactagtagtgcggggaccttttaatcttttattactacttgttgcattcaagcatgaagcatggacagacactcccttagaaagaaaaacaaaattatgaaatttcctgcttcattttgaaatttctgcggaaacttatgatttggatatattataaacatagtaactcctctacattaaaaaaaaacattacaagtcttcttttcatttgggacataaatgttaaaatcttttatagatactgtatttaagtcaatgatctgattatctgacagacatcgtgagactcctcatgccatcaaaataaggcttcttcaagatctctatttgcattgtcaaaaatcttcaaagctgtaaataattttcgagtaatcttttgttctcggtcagagagatatgtaataaataaagtttacttttcctcaaagttgtacatttttttttattttttgttggtttggcaatttttccggtaaactatgcaaattctattcgccgaaacattttgcagatcactaaaccaaactgaatcacacgcgcgagccaaatgcgcgtgagatttcatcaccttcgtcaaaatactatcacatcacaccaaacccctgagccgactataaaaccttttagatctctccctcgtgttataactccgccaccaacaatatttttctctactcaattcactcacactccaaaagcggtagca

SEQ ID NO: 4708 - DNA, 1523 bp, Arabidopsis thaliana
tgcgcttggaatatgtggatgcatcagattatcaatgtacagtctgtctatttctctgcttgtctctagttttcatgacattggacgaagcttttgaaacttgcatgctatgttattaacatgataaggtcttccgttcatggtgttaatttggctttatgctacacttaatttcaaacttagtcgctatatatagttgaggtcacttggtgtcctccttgaatattggcccggcctatttcactagtcgttgaaccgttacgatttctatcttctcaaagttagctcgaccgtcaaatctctaagctcttgcaatctctgcttctaaggaacacaaaacagagataactttagctataaatatttagatttcaaaagcaacttgatttaggtaaatttgtgcacactctagaatagattatcatctgttacagattattactgtacaatccagcaaaaactaggcctgggatttcggattaacccaatgaccgaactgaacaaaccgtttttttggttctgataaccgactatgaagggaaggctaaaccgatcggcgaaattataattgaagttcggttctcggttcggcagacataaccgatcagttttctcggttaatagatactataaatataaagataaaaacattagatctaatctttttagcttcttctccgtttccttttgatcctcatccatggctatttagtcaattctctctatctgcatgtggttttcactatggtagcacgtcggggcatatttcgttacggagatatcgtcatccctcgctatcaccgtcaccgtcacagacgtagatctgctgattatgaagagggtagcggcaccaagataccatcaaccctaatttttaataggtttggatttttagttattttgggtttaagtttgtttttcgttttggcccaattattggtttgtaattataaaattttgtttatcttcgcccattctataatttttgttttgacccattatcttgattttggacttattcggtataaactaaccgaactaaaaaaaaaatcggtttagttcagagttgattttgaatcctataaccaaaccgacccgaaccaaatctttattcggtttaatttgacaaaattttaaagaaccgaaaaaaccgattaaaccaaaccgaaccgattacccgaataaaccgaatgcccaggccaaaaacaactgaaaataaaaaataaaaaatgagataggagaatatttaatccgacggtggagaaatgttgatataataaaacgtgatacagaggatcataaacccgcaacatgagaaacgtaataagttaagtcaaaaaaacgaaaaagccagaatcatatttgtggctctggtttctccatccaaacaaaaacaacacccaaaccttgtccacaccaaaatgttaaactcaaaatccaaccacacacacacaatttctcttcctctctaccattaacatcgatcagaaagaccgagagagagagggagaagctgattgatt

SEQ ID NO: 4709 - DNA, 667 bp, Arabidopsis thaliana
gggaatctgaagattctggagaaatctgaaatcagataaaaaaaggtaaagagtagcgtcaagacgaagaagaatataactaaaagcaatttggttagagaggtttctgtcgcactcctgcttttgcttcacgtcgtcatattattctacagccggccgtctcatttttattttgtaattgttatcatctgagccggattttacccaactcaaatcattccactatttgaaattagatttttcttgtaatagttaatttccaagtaaaatcgaaagttatcaaaccaattcatatcagtttgttactaaaaagctaataactgttaacctgcaaaatccttttatgtactttgttttatgggtaatattcaaattagaataaattttgtgtaaaatctgtgggttcttcttatttaaaatctgtgggtaactttaaatattgggaaatttactaatggaaaggcataaagaaatgaggaccagccacgtcatcaaatcaaagtatcacattcctcttttctttttatttaaagaaattaaataatagaagaagaagataccaaaactctctttttctgtgcaaacactttggaggattcttctaggcttctttctaccacaaacacaagagcgcgttttcttcacgccggcgaacaacgtcagagtc

SEQ ID NO: 4710 - DNA, 2000 bp, Arabidopsis thaliana
tcaaaccttagacgaactcatgctactactacagaaagccaaatgcaaccactaattacagaggacgtacctgagaaaccaaagctttcttacttggagacaaaacttgctgaaacaaggactgaagagaaaaaatcttttataagatgaaattctcccgtataaataagcagttataagctatacacgagtcacaacatcatcaatcaacaaaactcagagccaaacttgttcttcgagactaaatagagactaatgcaaagttttttatcaatgagctatacacgagtcacaacatcatcaatcattgtatctcaaaacaaatcagataacacaatctggatcctagctttctgcatcaaaaatacaaaagacctataaacacaaaaacaattccactttggatgcaattgaacacgtcaaggaggcagctgaagtttgtaactatggatggtcaatctaaagagggctaaagtgcagatgctaaagtggcagcaccaaatggttctgttgctcctaatgtagagacaacaaagcctcttaagagcaaatcgaagactcaaaagcaacacaaagcaagcaaagcaacacaagccgtaaactaaagctaatcgaagaatcaaaagcaacacaaagcaaagtaaagcaaacccacaattaaacaatgtaaccatggtggatcaaacccaagaacaagtgattgcaacaaggatacaaagagaaacaacgagagagacatggagcgagagagaggaagcgagagagggagagagagagagagagagagagagaaacacaaacctactacactccggcgatggatccgacgagtctccagtgaagaatcggcgacggcgagatcaccggcgaagaatcagcatcattgacggctatgaatctcaattttgagtgttttgtgtcgaggagagggtgaagaagagatgtggtttttggatgtaattccatatattagattagggtattattgacattttataattttggctgaatcagcttcagcagaatgaacaaatcaaactcagtcagattttttttattttttggatgagtttagaaaaaaacattcaactgaatcattcaaatgatctatttaaacatgaaaaacaaacaacaattttcatcttcattgagatggttcatccaaatggacaaacaaacaggaccttaatagaacaacccaaaaaagaactcttacaaattgattaataaaataatttaatcaaaaagaattatagatttttattttaaaaactacaaatagtttaaaaaaaatataatatttacaatttccatcacaaattgtttcttaatgcccaaggatgaaggatcacatagttaataagtaattaagtactattttattcatgtactttctctttgccctatccagagttgctacaagcctaaaactcggttttaccacgatttttctttggtgtatttgacagactattaatggtttgtttatctctattatcagttgaattgttatatcaaaatttgaactgattgggtataaaaagaaactgagaactgattcatgctaaggaaaccttgtttaacaaataccatggatgctttttaaccgtatcagcctctccaatgttttcgtaaatcaatagttcaaaatttttttctaccacacaagtgcatctccattccaattttcaatctatataaatcatatgtattttttgtatccaatagtcatctttgtaaagattttttgttcgtgtgtggcggataagcaaaaacagaataacataatctcttatccaacttatattgccacgtggacagatatagttggtgaagcagatactaatctaatctgagcaaaaccagttgggctatttgaaagccacaagtacttggaacctttgtttcttctaccctaacatagcccttgcaaaccataaccaaaccatcatcatcatcatctcttggtgacagaagaaaagagttgaggaacagagaaa

SEQ ID NO: 4711 - DNA, 2000 bp, Arabidopsis thaliana
atgtgtttgtctctcacttctttacgtaacctttgtagattctctcactctctctcatgtccatttgcgccacgtcactcagatggttgtaccatttgcgattatttgatctcaatgtggattgttatacgtgacatgtcatcgtcctattggtttagaatcaaaaactttaatctcccgcgtccccttacccaaccaaaaaactattgatgatcactttgccttttttttggccgtccattattgtaacgtatactacacttgtcatggtggtacgactatacccaaattaatactttgaggagtcaattacgtagatgattaaattatgaatattatctggaagagatcgacgacatttggttggtgtaatcaactttttcgggggtttgtgtcattcataaataacaaaaatttcagaagaaaaagaactaagttaatcattagacagaaatttcaatagcgtaacttcaaaaaactaattataaaaaaacaaaatcaactgtgtaacttacgtcagatgtaatgtttattagatgtaataggttccactaatccatatcaatattatcatttatgagatggagtgggattttgtcttttatgctacattaacaagtacatgataatttctgggtttcttttaccggtcttaatattaataaacatgttggtatgcatggttaagagttaggacttaattaggaggaggctcatacatatatgacagaactgaaaaattcagtagcaaacatttatctataacatgtcgtgtaaattacgttggttctttttacgacagaggtttactaatgtatatggattatctcatactcataatatgtagttacaatatatatatatatatatatatatatatatatatattataacttttttgaatctagattatattcaaagaaaaaagaaacatttatacatgtgaatgcaaaatgcaaactttttaaaaaacaaattacaaagattttctatccttaatgttgctcgatgcaaaccacgtttggatctcatccgcatatttcttcacttctccttttcttaaagtgctcaagtgatttcaaatgttcttatcaatcaacttaccagttatatattttatatgcatggtattccctatttaaacaagttcaacattcctttaacaaaaagaaaaagaaaaaggaaaacaagttcatgcctctcttgcctcaccttaagagtagacgtaccgatgttcaggggcgacctaggcctctaatacgtcttcttatgatatttcaattgtcaaatcgatggtcacacaacggtagtcatcgtagatatacatttgatatgtttgttacaacagttatcttttctttattaatggtaagccttaacataagtgttaagacttatgattatatgccttgtatatttcgcactatggttttatattgtttcaaaaggaattcggtgagttacaattgttgaagtcattattttatttgccattttttaaagtatcaatcctttaaaattccgaatttatcgtttactctccttttatgtaatcatgtgctcttagagccaatacaactaactttcattttcttatataagttaaaacattaacaaataggtatagatttaatttctagaagattatggaaattaaaacacgactaagtgtttttttgcagaaaatgtatagagagagaggggccatggatcacgtggaggatgcgtgagatggaaatgaaaaaacgaagggagaagagagaaagagtgattttacaaatctcctctaatcctttctcagccaattatgatcaatctcccacgtggggcttctggccccatgcatgcatatcatctttcaactattcactcttttgtctccttcttcatctttttgcgtgatcttcttctatatatggctgtctttatctccacaagtggcttttagaaagaagactctcttttaagtttgggtgttaattctagggtttccattaaca

SEQ ID NO: 4712 - DNA, 1139 bp, Arabidopsis thaliana
aagtagtagaattgtaatttaatagccttgaggatccggcttggtttggttcagagaggccaaacgagagtatctcactctcgaaagtaattgttgggagggttttagattcttgatgaactcaaacaaacgaattgtgatgaaactatttgcaattataagaagaagagtttgctcatctccattctacaaatcctgcaagaaagattaacactcttttatattcagtgttatgttatgatatttaatctaccaaaatttggttgaagaactaatcaaaatgaacttggttagcatcatcatatatataccaactaccaagtaaagaaaaagtttgataaattcaattattcatgctcttcaaataaaatacagaacccattaaaaagggtccacttatcatcaatctactcttgcattatcttgagtttttgtgtagacataacataacccattttataagttatgaccttattagaaagggtccacttatcatcaatctacttagcattttgtgtatatttctcaaagctgacgttatttaagacgtcatagacccacttcaccacaactcaagtcgtcttcaattgctgacgacattgcttacggtttttgaatcgtcgtcacaaaatttaggagattggattaggaattggctctttctttactattctccaaagactttactatttggtcagtcttcttatttctcacctttagcttttagataaacctctgatttttttctcccatctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaa

SEQ ID NO: 4713 - DNA, 2000 bp, Arabidopsis thaliana
aaaattgaagaagcttccttacctgtgaaggaattaatcgaaaggtgacgcgacggagaacaaacgacggtgaagtaaaagagattccggcgtgagattcgtctctcttacatagcaaaacgcatcacctgcggttggctttgagattcgctgaaagtttatttttgggctactggagaatcttataaagcccaataagagaccacagagcccaataagttattacaaatctacgacagtattaataaagaccattttctacgttacaaaattttgattattaactgttatagaaaatggttatattgaaacgcatatttggcatttgttatagaagaaagaaaccactcttgctgagtttttgttggttaaagcgtgacctaagtctgtctattgagaagattcatagtccatgaaaaatccgatgctactataaatgattgtttactaatcctagaaaccaaaaacaaataattgttttctcaattcaaaaattgtatggtaaaattttagggtttacacatttaagattttaagtgttatagatttccggtgcacagaagaatggtatatattgtgagtttgtgattagttttgttatgcaaacttctcacgttaggcaactgtaaatataatatctccaacaaagcggtcatgcaatttgttttgttgaaaatttgtatattttactagcggtcatgaatttttaaatcccccacactctattttttaaaatatttttaacgttttgggaccatgatggatgttgaactttcatttcaggatttggtggaacgataaaattggaaaggctttggagtttggaacctgaagaacttataaagttaaaggatgacacgtgactttaataaagaaatgcaattcccataatcatataatagtccaaatttaggaagaaatgggtgacatgagttttaaagaagaaagacgtcatgattccattaaaacaaaccaaattagttggtggcttggtgctgacgtctaccgacttttccaccgtccatccttcgacgatggttctttctaaatgaccttctcagttttttcctgtcatgcgtattattattattagttaataaggctccactactactcggaaagtccgagtacaaataatatgacaataatgtcaaacttattcttagtattggtttaaaagaaggattcaacaagagtacttaatcacgtctcataattaccactttcatccaaacatggtcattactatatgacatgatcgtgttacattaatttggaaagtagtatatgtctttttcctaaaagtttatgtttagatttttgatcactaagaatataatgtcatatatattattaacctttacacctaaatgttatattaattacttgaatgataaaacggaaaatatcgaaagtttaggctaggtctctctagcatctctagtgtatttatttagcaatcccaaaacaaaattgtgttttctacaattttagtattagattaccaaaattgttgtatatagtctggtgattccgttttgatggtcgagatcgaaagaagcaagcatccactatgtggtcgtcacatgcgaatatttctaagtatacaaccatctatcgaaagtttcgaaacaacccaaatataatagtaataaattctgagaattctcctattttttattgatatgaaaaaagcagtaaaatattatgtaaagtagagaggaaccaaaattaaaacgtgcagatttattaaaagaataaagtgggatccaaaaagtcagcgtgaaacatgtgatacgatataacgacacggtcctatgactaagtccactccaatccagtgacgtaaacagcaccatcacccatagcttcctgtgacgcacatccttacgtaaccatcgttgacgctagactttcctctctgatctctctttcttcatgtatatataacaaaaccttcctttcctaattggtatctatctttaaaaacatacttgaaa

SEQ ID NO: 4714 - DNA, 770 bp, Arabidopsis thaliana
ggtatgattgaaaatagcacatgcttgtccctgcatctttctttttatccttatgaactaatgaaagtgaaatctcttttcttttgcttctctgtctaaaaatacataaacgcttagatcatggtatgtgttcttgtagtgatatgttatttgatcttttcttttgtagacatatgtgaagattataacagggattattccacacaagttattctgaagatcatactactggtttgtttattataggctaggctaatgtggtaatatatggttcatacttcatatagaacgaaatagatatatttgactttattctggatatatgctctgtgtgcttcagtaacacaccaaaatactctgaaatgtaagaataaatcttagccatcatcgatcttctgctcttagagattttcccttccttgatcgtagaacgttgacctaaagcagaaaagcgagatgtaggaatcttcttacggtatgaaacagcaatttctttagcctgaagatctgcagaaacagcaagcagaatataagagctagtctaaactgaggaaaagataatatttcctcagtttaaactagattctcccgccaggaaaaaacttcttcaaaccgtgagtgatgatgactcttcgaatgatgactcttctaatctttacgacaaaatcgtgacatctgtcttttgtaaaaaacgttacaatggtggttactatatatgtagtagaggttctgtcttcttatctttataatctctaggcaaactcacaaaa

SEQ ID NO: 4715 - DNA, 797 bp, Arabidopsis thaliana
cgatggtgcacacgatagaaacgaagaaaaccctaaattcttcgatgattgcgtagggtttctgggtatcatatgcaatgcctaaaaatcccatagaaacaaataatcaacaataatgaattaagtgaaaatagagatttcataagctttcgtatatttaaacctgaggaagacgatgaaagctcatcgccatagctgcagcaaactctcagttactcggagaaaatggagggaagacagtggaaaagagccttatctgcttttcgcttcctattttggcacacgtatgccatcgcacgtgtgaattttctttatgggccgtttgttattgtgggcctttagtatatcaatattaatataaatagatagtactatgatttataaaaatatcaataaaagagtcggctaatgacacagtcttattatgattacataaacctataatttgggcccaccaccacgtcggtcgtgtgggccgtcgcttcatgcgtaccaaagtggtcaccgtggcatgacaactgttgttctgccttttggctctaccgtaacaaataggacacgtgtcgcgtcttcacagtttatgtcgtgttctatctctctctgtctctctctctctcccgccaatatctctctccctttggtctcttctctctaatcgctctctctcaatcaaattaattcgtgattctgatttatcaaacactaaaacaaatggatttgggtatttcattttgatccgtaaaggttgattcttttttttttttgttatcattgaaaattttgttttgttgtgagag

SEQ ID NO: 4716 - DNA, 2000 bp, Arabidopsis thaliana
tttatactctttaaggtaaaagtgtgaacgtatcatctctaactaaaactaaaaaattgtttctaacactgagtattaaaaatcgccctacagtttaaattgccagaaataaaagaaaacgagaaagaactaaaccgtttaaatatcaacatttgagctaagaacttcaatcttacaattaaacacatgaagaacgcgggaaaagtaagtaaccaattatctaatagtccaaagtcaaaattcatggtctttcgtattctttaacacacgatctgagattgaattaatcaaatacaagtaggttttcagtatatatatatttcgtaatcatgattcgattcaaataatacgttttgcggttttggtgtgagactttttgttaagagatatagtcatatacatgtcacatgtgtatctgatgaactgatttgggcatacttcatgctccaagcatttaggcttaagatatcaacattttgagatctataattaaagcaaagagatgtgaacctatttcctattgaccagattacatggtccttatttattaatcagatcgatctgatattgaatcagattaattaaatgcaagtaggtttgaattatatctttcataattaggcattgattcagatatacgttttggacttttggggatgtgagaagacgcagtgacaagattaccgtaattgtgtggcttaagaaaattgttttttttgggattgttaagccactctattaaaatcgttataatttttatttccatctgcaagtattttgaagatgttgaatgacactataatgaacactaagaagtctaaaacttagatgtttttgggtaattatatgaaacaacacaaatgcataacaatgaatcttctcgaccacagagtcgaataagagtaagaagacagaaagggaagtatagaattaaatcttctccaacatgcaaactcatgctagctcatcttaactaatccaggtcagcaaaacaatctaacgcaacactccaatacaatcaacttcatgtgataacaaaatgatgatctaagtttcttcatctcgaaatctgaaatcacgataaaaatgtatttagtctactgaaaataaaatgaaaataaagtactttaaaaaaataaataacaatttcactatttcaatatttaaattaaaactcgagtaggtattaattaaattaagaaagaagaaatctaaattactatttgatatttctagttgactggtcaatgataaagttcaaaataaatcaaagtataatacttcatagtcacataaagttttgttttgtttcttataatggttttaggtcaatctcagttcacattgttcaaatatcctaaagtttttaattcaattggttaaaggatttttaatcaaagattgtttctgaaggttttgttaaaacactataaataccttcaagaagataaaaatttgataattgaggaacattattttaaaatgcctaatggccactagtcagatttttatacatacactaatatgcaaatgtgaaagagccaaactgtgtctataaataagcatcttcatcctcaacttatggattcatcaaacactaacagcataattatcgatcatgttcatcatctatctttttatctttctctcatctgccattataggtaattaagctcgctatgtctcttagaccattaatgtttttagatgaaagagaacagctagaattccctataaagctccaaattaataattttctgttaattgaaatttctgcttttttatcatgacctcaaattcggctttgatataaaatttccaaagaacttaaaacgatacttccttctgtttagaacaaagttgatgattggattaaaaaaacagttgttttcttttgaatattcatagtcccaacataaaataatactaacgactatgaaataataaaacaaaatataacctaaatcaattatatgtttaaagattcaaatggggttgca

SEQ ID NO: 4717 - DNA, 970 bp, Arabidopsis thaliana
gtgacaaattcctcgaaataccactaggagaaacgccctcaagaataaacaagtcaaatccgtaaccgtttatgttagcgtcaagaaaagagttaaaccctgatcagctgatgtcttgcactaagctatgtaagagtgatgatggctctaaaagttgaatgcagagcttttggcttaggttatgacttcgtgataccttttcttttgtaatgtcatcatacacgctaaggcttttgtgctacattattactctctttgtctttgcctcgtttcaaaaaatccatattcttagtgaagtaaacagtaactgcaagcctctgttgatcaacgaccataatgattatctttctattttggggttatatataaaaatagaagtttaaccaaaatgcaactcgagatgggcttgaatcactttgttaatgattgtggagaagaaatgttgtcgtgtgaagtgatgggacttcaaatgtgtgtcatcattgcgtcatgactgatggcttcttggtttcctttgtcttttaatatgtttatcttcttacatttttatatgtttgtccttgtcacgtatcggtaatgaaacttcaaacttgatataataaacgaataataggtatgaatactaaaatagttagtgaagaaacagtttctaccaacaaaaagtaatgtatcttttcatgagtgttaagtgggcaatgtttagtgcgtttagtcctttttagtctttagagctgtttccttatctcttcctcttaatcaaaattttctaatacgatttattcagagattttaatagagtaaaatgtgacatttcggtattgattgattcatagattaaaaactatataagccttggttccaacttccaacttccaacttagaaatgtgtatatacacacatttgcatcgataataactcaccaacactctctctgtctccatcgaatgtttcctctaactctcaacaaaa

SEQ ID NO: 4718 - DNA, 483 bp, Arabidopsis thaliana
tagttaatgtcaggtgttctgttttgtagtctttaatcaaaatgttcgattttcgcaatgcgtaatgatctttgtctttatcaatcgaatggacgaaacaaaaaaactgtttgatattgttacactatttgtttaacacaaatgcggaagagcaataaacatctatgtttacatatatatttttccaccatatatatcacttttgcaagaaaaaattcctccatacgattatctaccaaaatgacactggttttcttcatcaatctactacacactttgaacattgtcggattccgggaataagaagaaaaaaaagaaaaaggccttttctattgggctttatgcttccacgctaggcccagttactgtgcttcataatcatcacaaacgtcactctcaagaaaactctagaattctcttgagtaagaagatcaagatttataactcagcttctgttactttctaagaatagagaagaagaag

SEQ ID NO: 4719 - DNA, 2000 bp, Arabidopsis thaliana
atattgattaccatacaaaattcaaatactatctataaaaatatatttttatagatagtatttgaattatataaagtatggttttcaaagttactaattcataagatcgtgtcatgtgtcaagtcaaacgatcagatgtttacatgtgtcattaaaaatttaacttttttattctcttaaaaaaatagaaaatctaaaaaagtaaacaaatttacatatactaatttatatgtctctatatataattatatatatatttaacttttattcaacaaaaggaaaattaacaaatttgtttttacatgtattattgatcatttaaatgtagcacatattatttttttttttaaataatttagtatggataataatactaattaaaaagaccattgaagtttaaaatagtaatataatttatttaacattagtttagttggataaaattatatttgtcaatgtaatataatgttttcattcgttaaatcaaaacacaaaatattaattataagaataaatttttgaatacctatgttttaacctaagaattttaacgcatcgtacgatggagcgtcttgcatcctttgatgtgttactatacctatgttttattctaaaatttttaactcatgtaatcataagtgaaaatagaatattttgagaaaaactgcttataggatttaacttttcaattacttttaatgagaatatttttatttattaattttaactcatttaaaattaatttccatgatgtaaaattaacttacgagattatggcatataaaaaataaatattttcaacaatgtttggtttctaaatatttttgtggatttctgttttttagttaattatgttttgttaattgttaattatttttaatacccaacaaagatcatttctcttatatggatatatgcaatgacagaagatttaaaagtatttacttaaatgatactttcatttttgttttatttttagtttttcatatgaatactcttgaaatcttgttgagtttatatcaattctatatatttaatcatgagcctataacaatgttgttggagtattatatcagaagaatacataaaaccggaaatagtttatttataatcaagttagacaattttcaattcattcaagacacgatcatttttctaatattatgaattcaaaccaaagtgattcacacttttctttcacaatttatgccggatctagtacccataaaacataaagttaaatcaaactaaagtgtgaattcaaaagaacaacaaaaaaaaaccattaaaattagtttagctttgattgtgcctcaatgcaacctgatacaccactgataagacgacatgtcatcaaaatgacacgtgttaaaatatcattcgctatctaaacgtacacctgcgtgtcaacataaactgaggaagttaatgaactttttttacactgcacgaagaagaccctctcaaaagcacgaggaaggatcaaatcggaaacttaacagaatttagctaccaattactgtctccggcgagatctcaatttgatccttcacggtggcgtcgacgtccgggcaacaacaagctctctcgagaagaaagccattatcatcatcatcatcatcttcatcatctcctcctccgtcttcctcacctgttcgagctcctgcggcgaagaaaccgagtccggaatacccattttggcagcagaactggtttatcggtctgctattcgtgatggctttaggattcttctgtctcgctatcttcctttacctaagtctcgatcctgattccggttacacgtctgcctccgccgctgcttctggtaaagaaggtgtcgaggttcgttttcgatttcattgcttatgattttcggtgaatgtcgatttgtttcaatttcccatagatttgggggatttgtattgaaattcgaattaggtttgatcatcttctcgttgctgtgatattgacagattacttatggaagtgcgatcaagttg

SEQ ID NO: 4720 - DNA, 2000 bp, Arabidopsis thaliana
atagagagacttttggcgggtctttatataatgtgtgtacccacaaaactaaccatttgacttttctgaatttttagaattaagtatgactttttgatgcctttagcaagttattccaagtcaagtctgtcttttaaacagagcaaaagacataaacatttttgtactccaatgtgttcacctaggaaactaatttagtattgccatgacaactaatagtcatgacaattttattcttaattgcaatttgcaagatatatatagcaattgcccttaagatataccttaacgcaaacattattcatttttaagataaccatatgcactaatagataacgtgttgtattcctttttccccatacttcataactctttaatcattctctgcttgttttagttcagacgtttccctcatacagagtggcatgtcttagttacaagacacaatttatactgattttgtatgattgataattctttaactatctttgatacattactctaccattttcgtatgattattgtcttcgttaaaaggttgagtatttaatagaaacggcatatttataatttatgtatgcttagtcagaaccacgtctatgggacttgaatatgctatgttctcatgataagagatttttatattgagcaatcttcctttgatcagaaaatatattaagatccattctcactccatctttatgtgtcaaattaagcttgaaatcaatcaatctaaatctgtctgtttaggattcacgttacgtggctaacaagttttacgtaggatttatttcttttatgagatcttgattttgaaaatttgctgaagcggttacgatatgcagcaaccgatagttatgcttttatagcatctttaccactttttacgtgctcacaaggtaacgtttggtatatttgactgcttcagatctctacggacgattgcttgagtatagcctttggattagtcaccaaaagaaattatgttgttcagtgtggtttaagtttctcattaaagaaaagagttttttttttttttttttgtgcagcaatcgtgattagagacaaagacacaggaaggtccagaggttttggattagtcaccttctccagtgaatctgaagcctaatctttcataacagagatgaatgatcaggtttatatgactccatttgtggtagttgttctgtttatatgatgatggctttggttttgagttttcagatgatggatggtcgtaaaactgaaagtgaaatcttgctgtacagaaacatacaatgtagcatttgaaagtgaattgcatcatttaataccattacacagactttctcttgatgtcattatagtctactctaacctttaaccttccttataagcaagggacggtatcagcatatgtagcaatgcttctcaattagattcttactcaccaaagactagcttagggcagccagttccacgtaaaaaatggggtttgtttgtttctattcaagcttttaaaagaggaatagaaccaagattctaaaacaataaaacatgttccgatatttctaggaagagcggaaaatgatcaatccaaagggattgagtgattaacccccaccgtacggtcgagatattgcgtttgtggttttgaataatcaaaggaatcttcagcaattattaacccacaccacacggctggaagaattggcgtttgtggaaattatatagtttttgtggagaaatacctcatattgctgtcttcaaaggagacgtgtaagacaagctttaatctcctccacaaatgtaattaagagtcactccaatcatatagagtcaggtactcgattttctgtggaagcaactagtcttcacaggagactttttaagtcaagctttaatggtttcccacaaattttatatgagacaatccaatcatcaaatcgtttcacgtacagaaaaacagaaacaaaacaaatcaaacaaaaaatatgatgtattcttgtagagagaggagg

SEQ ID NO: 4721 - DNA, 2000 bp, Arabidopsis thaliana
cctcgtaggagctgagctacgacattgaagatatttttggtccgtacgtattactatggtttaataggttaagtgactatgaaaacgaagacattgtgtcgtaatcgtgtgtaatttcactatcttccaaataaagaaatataataattgcttcttgaatcggatgagctacacgtttttagatatttcgcaacctgtcttcttcgttagatctaggaaacattgatttatagaaatatgtttctattatttctctattattcattcaacatgttaatatcgccaccactcaaatatattgaccatgtcaattgtttgattgaactataagtttgataaacaattgtcaaatttataaaaatttaaaagagaaaatacatttatatgaaagaaaagaaaagtgcaaaaaagaaagaacaaaggataaatgagaggtcgattttgtttaggaggatatggaattgcttccaaatttagcaaagaaacataaatgtttttgcccctataaagtctttaaacgttattccaaatctgttccaacatgtcctcttcatccgacacatttcttatcctcttctctaattttttttgctaaaattaaatcgaaaattgaaaacgaatttttgagaactatgtaagatattttttttcttccaataacaacaaattaccaaacaactttttgtcgttttgttactaaataagtggtacaatgaaattataagtgatacaataaaatcatttgacttagatataataatattcaaattaaaatgacaacaatacacaataaaattatgagaattcttcgaatcatatcaaaaattaatttttttttttcgataacaataaattattaaacaactttttgtcgtaagattattttttcctgataacaataaattattaaataattttcgatcgttttgttgttagataaatgatacaatgaattcatttcaacaacttagatacaacaatatttggatcaaaatgaaaattataaacaaagtatcatatatctttgtatcatatcaaaaacaagatcattttttccgataacaataaattattaaacaactttttgtcgttttgttgctagataagtgaaacaataaaatcattttgacgaattagatataacaatattaagatcacaatgaacaatagtaaacaacaaattatcagatattttggtattaaaaataagattatttttccgataataacaaattattaaacaatttttttatagttttgatgctaaataagtgatataatgaaattgttttgacgatttagatacaataatattaggttcaaaatgacaatactaaacaacaaattatcagatcatatcaaaaataaaattatttttttcgataacagcaaattattaaacaactttttttttattgctagataaatgatacaataacctcattcgatatatataataatattcaaatcaaaatgacaataataaacaataaattattatattgaatcatataaaaaataagagatacatgcaacgaataattaaacaaacaaattaagtaataaggcaatggatagactaattaatgaaactaaaactgtggattatctattttgtcgtctttcggagaatctaaacttcgaccgacttcaacgtatctaataatcctaaagtaaccttacgctcacagttcggttactttaaacttcgtcaaagtcattttgataaacgtccacatcacgaaacggtccacgtacgtctatctcgtggataagtctccagccgctgtttcacatgcttatctcacagctttgttacgataacctagtcctatgctaatatctttaaccatagttaaataattttaaccaaaccacggttaagtgtttcaactacataagtagctttgccggtgtattacaaacaaacaacacaaacaaaaaaaaagaactctttcgtcgactaatgtgatttattgttcaccggagtattaaagaag

SEQ ID NO: 4722 - DNA, 2000 bp, Arabidopsis thaliana
atactttttttaattgtatatttactcaaataagatctttctcaattcagtcataccatctagaatgacaaaagattctttcatcttacatggtattaaaatcctttgatctttaaattctataaattacagcgctgtcttttttctttgctatgccgctgctgcctaaacaaaacaccaccaccatcatatctataataaattaaaatttataataaaaacaacttaaaattaatctgataaaaaaacaaattaacaaatatcatggttggaatatgtttgttttctttcgtatcgtttgctttatcagtaaacaaataattgatttttaccattcgcgttagtagttattaaatatttgataagattattgtgacggcaaattttattggaatatataaataaacatattaaattttaaatttaacataatactatatataacgatattattatattttcagcttattaaaatagttataaatttttaaatggttagatttatatttactgtgttatatatagtgttaacatatcattcataaatatgatgtaaaaatatatgattgtattaaaatttgaaatattttctctcgtgacagcttgccaactatcaataattaggaagataagtaattgtatacagtatttgttttctttactactcaatacatgataaatttttaatacttaaagttatatataatttcatttaataataattatttcaattgataattaaataataacacatgtcatatgtttgttaatttatatatatagagaaacattggtatgcaactctccatatctttacttatatttgtatttgaggataaaatttgtttgaaataattactatgttgataaatttatgatatttataagaacattaggaaagtttctttttgaaaataagcaactgattcaattttgtatcaaatcatacacttaaaattatctcttttaaaaaccagatttaaaaaataataattagatgaaaatatagttttttttgtcagaaatataaattataatttgagaatgtcattaacgaatcatttctagtaataataaatatattttttttaatttttctataaaatcaattgaaagttgttttcatcaccataagtcaattgaaagttgttttcctatttctttatttttaataagaaaataagaataaataataaaaacactctgaagtatatttttccaaaacaaaaaatcaaaatatgacaagcaatatacaataaaaaaagaagcaaaacatatttttatttttatttttttatagcaaaatataaattgtttccatgcaaagcctaaaattaaaaacggtagacccatataaactcaataataactactactttttatcctttcctctaaaaaataaaagatgacaacatacttaatctcggattttagtaacaaataattaaacagatatacatatcaaaattaaactcgcatttaatcaaaaataacagatctaaaatcattatcacacatcgtgtctgtttacagtttgctaaccaatagaagcagacaacacaagtcaacacgtgtcaagcaagcgcgtgggctcctcaccacacgcaatatatagaaaatccaaataaaatcaatcaaaaaattaacaaactataaaaaaaaaacattaatatcaacataataaataaaaacatttaagaaaataaccactaaatagataaaatgtcttttagtaataagaaaaaaaaaaaaaaaaaagcttcttcactctcactttcctctttcgtggagacaaaaaaaagaagccacgtaatatggatttaattaccaaaactgccactcggccgcccctttgttgacttatatttgtcgtctcctccttataaatgatgtcctcacaaacttcttcacataacaaactcatcaaacttcctcagcgtttctttttcttacataaacaatttttcttacataaacaaatcttgttgtttgttgttgtc

SEQ ID NO: 4723 - DNA, 2000 bp, Arabidopsis thaliana
gaataaacaacaaatgagtacacttctcgagaatgacctactatttggatttatgtgatacggtgtcgtatagtgtctttattttttaattaagctaatagtttgataaaagttttaagataaaaaaataaaaaattataaacatgtccgctctggccactggtgcggctcgcctagacgtattagatttgttaaattcaactaatgagctacaaaaattaagttattacttgtataagatggggttttggataacctaattatcataatttatctatctggtttattattccttgagatttatccttttgtcgaaagagattattccaaatctaaagtttaatgaaataggtttattggaacttggagctgtgataaataatacgtgtcgttgtgaattcaattatttaaattcaagtttttggacggtgttctgctggttcattgtctttatacgttggttattaccaacatttaagtctatatattcaatcatattgaataaaataacgaacaaaactaacaaatgaaactatatacagttacataaatggttcctgttacgtaatttgttttttctaaaaatcaattttaattatgtaaactcctctcctatatgaaagaatacaagctaagtaccaacagtagttgttgttgctctaaaacatatacaaaagtataaatagagcatatttacacacgtaaattgtcacttctccatagtatacttttatatatatgtgtttcggtgcggcacatggaacataaagaaacaaccaaaatcttctgaaacatagggaatgtgcaaagttaatttgtaaacatacaataattagaatactaagataaaattttagtcctaatttagtcttagcagtagtatgtcagtatctttttgttatgtcctaaaatgttagatacctccaaatcttcatatatatacatgttaaccacattattcaaatcttgaagatattagttattattttcataaaaaatttaaccacaatattcagatcgtgaagatatagttatatatatacagacaaaagacacccatcttttttacctaggaaaataaatcataccactttgttagacgtgctttaaactagagccgtttgaaattaatctttttacataattgaccactatatatatacacgtgaagcatccaaatactccacatatatgtgtgaatcagtgcatgccatgtacgttaaaaagctgttataaaaaacaggtgtaagaagatatggaaataaagtgacaaaaaacacattaaataaaagagagaaacatagagataaaaatggaccgactcaagacaagagaattgaagcagagtgcacacacatactcagtaataggccgctgctacggtctctgaataaaggagatcatcttcgcagttcactctcgttcatttattatgtttccttatctcttactgatcacattcaattccaaccatacaaaaagtttttttcaccccgataattttgactgcgcgataaaattaattacaactactatctaatctcgtctttaatacagtactaatatcaactaatagaacaatttcgactgtaacaagctacaccaatgattcggagcttgagttaataaaggcaaaaaagaattacaattacatttgtagactcgtagggtgattcagtctctagaccaaaagccaagcagtaacttttaaaataatttacagttttttagagaacattttttgtttttcatttatcttcagaaaaatcttgataatcccaataatcaatctttacaatacaactttaattgtgaaataaacaaaagtaggccacttttattaaaaaaaactcaaaccccaccattttctcttgttcttctttatctatctctatctctccactctctgtcttacattaaaacctcaaaaacatttcctttcctctcatcaatctaaagttgaagtcactacgaagaaatagtaagtaaagaagttgaag

SEQ ID NO: 4724 - DNA, 2000 bp, Arabidopsis thaliana
cttaagctatggatagttcagttttaagattcacgtgacttgatacttgaacctgttatgtttcaatttcttgcaggacctgcagagaacaaactctgttgctgttaccgtgaacaatcttctccagatgtgatgatagtttgtgtaaaatatactaagcacttccatttcaaccttaggtatagattaatgattggggacatatccttatccgtaagttttacacaccacccaacattccaagcttcacccgctgtagatataaggcactgtgtatcactttttgctatagagaagaagaggctctagtgtatagcttctgttcattgctctcttgcgaaaataagttcggatatttacataaggtgatgatgccctggtggtctggagatatcttgttgcagtctgaccttggctccaatctcgagggagagtaaccactctttgcagctgctcttttggctgctgccacctctcctgtataagaatgtgtaatttacaataaagaaaaaagaagtaaatgaaagagtctactgttattgatccaatagcctgtaatgtagtatcatcaaatgtgtgaactcaatttttttttcttctgaagaattatcttcctacattaactctatacccgttttgacgaacggataaacagtgaagagacaaattaacatataaaatataatttgtcataaccatttcgagtagatataatcaatagaaaagtatcatgttggtacttttaacgcaacttcaagccgaaaaagattgtgaagagattgtttctttcgaaggaagcaactttgattttgtccatgccgtgtgtaaattagcaatagcagaagagaaccacttaaacttattttaatacgcttctagatagctctacttggttcgataaatttttatgcacgttaagtaagtttaatctgtttctaataactaaaatatatgatgtagttggcataaaaaaaaccataaaatctattcccaacaaatgaggaatattcacatctaagatattctttttaaaaccaaaggaacaagattaacatgagaccttagacaaagggaatggccatgaaccattccataattccatttagagatagcaagtggcagatatatatgtgtaattcgaaaatatataagtatatttgatccattctagtcttcattaaaagatacacaatattatcatttatcaattaagtggagggactgactctacatcaaagatagaaatagggtaatttagttaagcaagactcaagtatcaggaagtgagatcactactttgcaacaatctcttgatagccatctgaaatcttcttcagatgctaatctcaactcatggaaacatccatggcacggtgtattgacataatgtagcaagttacaaacttacaatgcaacatatggggaaaatctgaggaaaaacataagaaacgatgaacaacataaacttaactaataagaataatgtggtattatatattatgaaaaaattcaataatctgtttttaatgtaagttaaatcccgaccaagaaatgataaaaaagatatttgttcccacattcttctggtacatgtttccaggtcttctcctcaatctttgcattttaacgctcttcctttaatacatttttttttacactgtattaattatgagataaaccccaaaaaaagtacattggtacacaagcataaatacaaaaatatgcatgcttttttcagaactgtttaaaggtaaagcctttttctgcaaattttcttttcgtgtatgaccaaaaaaaaaaaaaaaaaaaactttattctaaaaaataatagaaaagtagtgtgtcttcatattgcagtgtcttgtaagaagaaattcaaaaacccacactgacactttaacacattgcttcgtcttctctaccgtttcgatttcactcttaattatgtcaaatccgtaagcttttgtgatcatcaacaccaaaaaaaaaaacctaacttt

SEQ ID NO: 4725 - DNA, 569 bp, Arabidopsis thaliana
tgttaagtcggttactgtctcgcttccgtgttgaattcgcaagtctcgatttttcgatcgtccatgactggttttcttaacgtgtttatttataatttatttcgtctatcctccagattgatgtaatgatacattcaaattaatttaatttagtataaccatttttgttggtcaaacgttctaacatattcgaatttcgcatctattaaaataagacaaacacaatccaaatataccaatctaatcgaatttcaaactaaaccagaataactgattgagaaaccgaacaaaaattattttttgggtaggtgggtctaatagaacatttttgaaatgttgggttttaatttgtaacttttagaaactaagaatccaaatttgaaaactattttataagtttgacagttggtataaccaaccaacttggtaatgtgctagtgatcagaatagccccacgcaacactaacgtacaccacaacataacttgagcgtaatctcgtcctctatcatgtggttatgccgtcgagaaaacgagaacatttgacaactttcacctgcaatcactctca

SEQ ID NO: 4726 - DNA, 1830 bp, Arabidopsis thaliana
aaaaaagagtttttttgtgtttcaataagagaatgcaggtgaagcttctataagtttgacgaatgtgatgagtctttgagttctataactaaaatgaatgtgatgagtctttgaggctttgagctaagagttatacctactacggtaagaacccgtgttgcgcaattgcaatttcaaaggcttgcattctttcgcctcgtttatttccatttcgatcataagacgatatctcgttaatcttgaggtcaatagaagccttaatgagctcttctccaacccgtttagctgcttcctgaaatacattaaacatgtaatgagaccaagagggaaaaccattgttcaagatcgagtttccttgaccctgaattcttattacattgtaaaaatgtaactgcaaatataacaagcaacaacttcaactagactagtctcttctatctaaccctggaactcgatgccgtcacctctatgaaatccaaccattctctcaatcaagacagaaaatttgtgaaacaactgatgaccaatgaagcaaagacaatgccacctatacaataaaccgtgtagatatcaaaacaaactccaactaaatgttacttaaccggctaaactcttatcaaagttcaagagtgaagcaaagacaatgccaccaatactgtaaaccgcgtaaccaacaaagcaaactctgattaaatgctgcttacgcggcgctacactcttatcaaagtttgaagatttttcaagagacacaacagattcaagattttctggtggctaaacttacaatgacagtacatggaggatctccgcgaatggacttctgcaatgtactagcgtagaacaaacactttttgttaaagtcatcaaccaacatagcatagagttgtttatctgaacagaacactgaaagtcttggttttgtttgtgttccagtaaactgtttcaaaatgaaagaaaatacttattaacaagttcggcaaaaaaaattcaaacttttgtgcattattatatgaaagcacttctagaaagctaccttcttcctgctcctcctgttcctagttttcggactctccactcgagtgttccctctcgcttcaatcacaaacggctttactacagacatagctgataaaagggtcgaaaaatcatgaaccaagtaagcgaaacagaggataataaacatggaagaagaacagagtaagacgaattataccactcacttgttattcgaattggaaactggggataaggtttcaaacgagttccgagaatgtcagagactctaaactgaacagtagaaagagaagtcaaagcagccatgccaagtatcattcgtaaagcatcgaaagtcagaacattaccctcagcggaatttaatcaaacaccttctgtgcaggaataatctctgggggttttatcaacactccaaaaaaactggaactttgtaaataaaattataaatgttcgtacctttatgcaaaatttctcacagcgtaattatctatttcctttttgtcctttatgaaagaggataaggtttttaaataataaatactaaattgtttttaaaagaaactaaaaataaatggaaagtcttaagcgtcgtcaatggttctagagtcttctgcaactttcttttcatgaaactactgtaatcttctgctaacatatataatctcaaacactatcttctccaatttcaattgtcttatctttcgacttttcttcttcttcttcttaagagatttttctccaagaaagttcgctccttttctctgttcttaacaaaaaagtctcggtttttttctctttgttttgggtactagcgtg

SEQ ID NO: 4727 - DNA, 2000 bp, Arabidopsis thaliana
gccgatagcgcgtttctacttgtgtgattgggccttaattcaaaatttatcagaacgaagcccaattctcagtgatacaatataaacttataacattttttgtatggatcccggcccgcgtaaaccatttccagtcccgtataagaaaagttggatcgaaagtatgtatttcggtaggtatttaacaaaacaaaaggggttttagcaaaaatataaaacgaaaaggtattacaatctagtgaaagctacttggagtggaacaaagttgtagaatctggtctctcatatctcatttcctcttgttttgtaaagatggcatagtcgccttttgtagcttgtaccagaaaagggaaatgttagggattctgtccttttacattttgttttcttgttaaaattattatgaatctatcctacgttgaagaatgtgtatggtaacaacccctccacttctaattattaggtttatatcttcttcatttttttgtcggcattaggtttatatctacatctacaaaagaacatagaaagtaattcgaaatttaacctatctattattcaaaatatatatatatatatatatatatatgtttttggtttttcttctttttcttttgtgaaatccaaaataatgtcaaatcttaattttggaattattctctccgttttattaataattaaaaaatcacgtcaattaaaaaaaaaatctaataatttaattgccgtgatttagaaaatctgcttaatccatagatagccgcactagagccggccggctttgactttggttgaagtgtttgacgccagctcagaggcgccgaccaatgaaggacgaacacagaaggattaattagcaacaagtgtccccacgatttttcatcaacgattgacacgtcatcacaaatcaagagggtaaattgctcttgtcagaaatctttagctccgtcagttatgtggaaaatataattaattcacacgactcggttactgattttatatttttatccgtggactggcatgtatgcacacaagtgttattgcccgtgtcatacggaccacatccacatagtagcttaagtggtcaagattgttcgatgttccatttatgttttctggagtttgcttagttcgtcggtctctatttataatacgtcatgatcgtgtatttaattacatgtcaactaatattattaattacaagtagtcggaatataagttcaaaaaaatgatacagccaaacattagtcggaaaaagatattaaaaaggaaccgaccattggctaaaaagacacagtcattatgactaaacatcgtgttctttatgattttcttgtcggttactgaagttaaatagcgaacctaacacgccccatgagtaagtaatccagattgtgtgaaaagtttatgtaaaagaaaagatacggtcatgtaatcatgttacaaaaaatgacaaaaacgcgaacggaaattcaatgattttttttggataaagaagttcatgaatattaaattagacttttatgacagattagtttaggtaatcttaggtggggaaaaaaacacaagatgctttcgaagttatagtctagctaaggatatatggttaatatacgtttggtggtggcgagtccacaaatataaaatgaactcaatatatatatatatatatatttttttttgtcggaaactcaatatatataaatttagtcataaatagcaagaaatttataaattctgttttaatcatttttaattaacaactaatattttcctgacttctatacacatataaagaacaggcaagtccgaaccaaatcagaacaaaatactcatacacacacacacttggatttaaagaaaaaaaggagttttccttcttcttttgggtgtgtcaagtttctgttcttccttttctcgtgcttccatcacgagatatctcacaaggctctcgcgactcaagaaaggtaaagataaagaaagaagaagcaaagattccataa

SEQ ID NO: 4728 - DNA, 2000 bp, Arabidopsis thaliana
tttttaatcaaagaaaaaaaaatgtagcaaaaatggaggagaatcttagaagtctctctctctttatatatagtataggcaagcaagtaacactattatatacacacgttagacaagcctttgaattggcgcatttttttgagtaagaaatgttattaataatgtattattttgtacgtaatcggtgtttgctgatgaaagaattagagacaacagtaaatcacacttaaaaaagagaggaagaaatccaataaatataatcttaatatgttatgtaataaaattgtgtttattttagattttatatatatgtatgtaggggaaaagatgaacattgatgctgttttttttttttttcctttttgtttcatttgttagtgattttggtgagaatttggttagttgcaggtgatcttgatataggggactatgctatttgtgttaaactttaattgataaagggactctctcaagtgttgacaacatgtctctatgcataaacataaaatcaatgaaaatttaattaaaatttaatttaattgtatatttcattaaaatatcaatattatataatatggtattagaatattagttgaatttacggtttattttaagaaaaatatgaaatactacataaacactaattttatgtatatttaaaaataaacattagttttatgtatatttaaaaatatttttaaaatagccaatattttatttttattctcttgttttttttttttaacatctagactttcattagattgtaaagggatgatacagatagttaaccaaccattgtggtggtgttgtgaaagtttgatacaaaccatttaaagaacaagccttattagcgatagtatccgctgctgcattccgttctcaattaacatgtcgcaaagatatctgtggcagtttatccatccaaaaccgaatgtcaaagagaagggtatctatttcgttgtgatctcccattgtatttaccaactttattagttccaagttatctccttcaaacacaatacaccggaaaccatgagtccaaatcatctgtaaagcgtggagaaatcacagtgcctccgcgtgtatcgccgaatttgctgcctgaagttttgcccaaccaaatcgaataacttaaccactattgtctctgactatccatccagtatttgtaaatgaacgtccctgcacatagccgctatcaaaattacatttaacccattctgggagagggggtatccattgccgactacggaaatgctcatgtgagtgaccaaacggcgagagagaatcatgatttacttcagaacctatcccagtcgtatctatccattcctaaacttcatagaaaccttttcttgcttcacttgcaggatcatagtttttcttttgaaagaggaaagcattccttgatttccatatcctccacatcatccaaaaaggtagtaatcgattgctgagagggatattttgtaccttatgaagttcaaacagcttgttgaaattgtcttccaaattctcttggttttgaggtaagttatcataaaccaaaatcaaaccaacacattgaacaatcgaaagggaacaacggaaaagaagaattagaccaaaacagtaatataaaacagagaatcaaatgacatatattaacatacgattttaagaactaaaaaaattaatccaaaacagagaatttgtgacagatttctggactgttaatccaaaaaagagaatttgacatcagtaagttttactttttaccaatctacttttttttttgttataaaggtttgtttttaccaatttacaagtacaaattttgttgttataaaataaataatttcgaatgtctgaaaaaaacaaagaaaacgagagatccgaaacaacacgtttcaagcatttctgcgatttagcttgagagagaaatatctcgagaggctttgtaccgaaaaactcgtcgtctctctctgctccaagtaaaagcttcaagtccaatactc

SEQ ID NO: 4729 - DNA, 1924 bp, Arabidopsis thaliana
tgccggtgacatccattgttttctctgtggcgtgaacattagttcgaaaaaattggaaccctaatttcccaaaatgagaaatctatctctttcttctctctctgacaacacaacggcttcaagaattttgaagtccccgattaaaaaaagtaaatcgccgacgagtgaggtaaaaaggtaattacatttgttttgggcctaaaacagttaaatatgcgcaaaagcccaatgtaatatctggcccgttagagctacaagataattaagaagagggctaagaagatgtctagaatattaaatgttagtcgtcacttgaccgctgatgtgaaagtgaacatttgtttttcttgttgatctttttgttacaccatcttaaaatatcttatctgttagtaaagctaactttaaatttataaacataggaataaaaccgttgtcccatatgcatcattattgtcaaagcgataatgactattattaaattacataagactcaatttgctcatacatgacatgaaatggtgtttgaatagtcaatcgcgcagccatgataatgagagtaggtaagacgtatttgctgcgaagatgtgtgactataataatgacatgaacatattgtgataatatataactaaaaataatatatctgatcataagcatgtaaatcatgttactaactaaatgaatctgaaatgtacaacaatcttatatacaaggaaaaagatgagttgaacaagcttataactatggttaaagctctttaaattatgactatttgtagatctaaggaaaattatgaatggaaacatattttatttgtttgaagaattaccaacaagaatatgcaaaataacctaattttatttgtcattgagctcaagttgggcaaaggagctagatgacatattcttcttttgccaaacttgaatattatttatgtagatgaatccgcattatcgaactggcaatacatgatgaggtggaaattaattttcacatgtgtttgttaaaaagcgtgtctgtgtcagagaagataatttaatcaggagatcgagccagagagcctggcggagatcactggaaatcaattattttagtttgataatataataatagtaatagtactaatccttacattagaaatttagaaccaaacaatcaattaaaaaatataattattcattcactaatcattacagtaaatagtaattacttgctagttgccagttcccactctgttgactattcttctctgttccaagaagttgtcaaaagagataaatatgtaaccatcaacgacttcgtcttcctcttcgtcttcgtccacggctctttcacattcgtaaatcgttcctctattattactagaacaagacaatgagaggtttattcttagataaaaattttaaagagatttctatacattttaagactctagctcactgttacattccattcaaaatttcttcttattcaaatgtttctaattattcttaattacgtattgacctttccatttttttttgccaactatgtattgttcacaaaactaattttaatcgaaaaaataccatatacagtactccctaggattctaaatttccaagatatttatttattcaacttcttccataccatgaaaatacgaaaaaataaacaataaaactccgtcaataaaataataatccgttgaaagtcgtcgttcaaagttgggtttttttcttcatattataaaaaaacactcgttcctcttcttttctgagttgctaaaatgccaaatcaactcatataattacacataaaaattcaacatttctctctcaaatttcttcattctttagctccaaaaaatcttcattctttcattctttttcctaaattttagccattgcccaaaactttacagaggattttcagacaaaca

SEQ ID NO: 4730 - DNA, 1541 bp, Arabidopsis thaliana
tctaccaaaaatctttggtgcttgatcgtgtgtgtattttactttaaataagtcggtgtcactctatgagtgactttatgacatgcatatatgtttatgtttttatgtttggtttctccttgttataataatactaaaaaattatgtacgacgttggactgtttcatcatatcccataaaaatacatgattggggtgaaaatcttgaacatattaaaaaaatattaaatcaaaatgataaagatagggatttataaatgtaaaacgggcgtgtcgagaattttatggacattgggacaagctttatatgcagcatgcatcgccgcatcgatatcccgaggtgcatcgtttctactttcatgtccaaatttggggttaactcacaatatatatcatgttgcctatgtaaatttataatcataaatctaaacccaaattttaatcctcattccaaagcaaaagttctaagccctacaaaaatatgtatttcccaagtttaaaaagaattaatctatacttttacaaatttaaattctgatctcttataatgttcggtttttccttttttatttattaagttagttaaaatttgcagttattttgttgaatgtcgttgtttacgaatttacgaataatacctttatagctaatctacaaaattttgatgactgacaacaccgttaatgtttttttttaaattaccctgagcctctcacttgcggtcagaccatgcatgtcgatagtccattacgtttaaggccacaatcaactatagtttgtttatcaatagccaactaagctaacttttaggttcctgccctctccgttcctccggtaccaatcgtttctttgtcccttcgatagtttgaaaacctaccgacggtgagagcaaaatattgatgaatcatccaattttcagtaataggtgtgtcccagggatatataaatggcgaaactacgcgagaacggttccttgttctgcaaacttggcggaacaatgctgctcttgagatcaaccaaaccatatgtttagtccacaacgatctatatgtctaggggtgatcctctaatcgaaaaatgttgtatttgttcgacgatgacgaaggtcagactatgaactgcacagtctgcacttgtcctaaccgcgagaatctctgacatcaatatacttgtgtaactatggcttggttaagatattattttcttgagtcttaatccattcagattaaccagccgcccatgtgaacgatgtagcattagctaaaagccgaagcagccgcttaggttactttagatatcgacagagaaatatatgtggtggagaaaccagccatcaacaaacaaaaagcaagatcttatcttttgatattggctacgggaagatgatgtctgtttaatgtgtggggttaccacgttattgtacgatgcacaagtagaagattaacccactaccatttcattataaatagacgttgatctttggcttatttcttcacacaacacatacatctatacattgaaaacaaaatagtaataatcatc

SEQ ID NO: 4731 - DNA, 2000 bp, Arabidopsis thaliana
atctcattttatccgttcgcattaaagttaaatagattgctgacatattttaaatctaatagaaaatgccatctggcaaataaacaacggacacgattttaaactaaattttaccaaaaagaaaaaacttatacgacttttcttgcttagaagtctttgcattgttaatagattgttgaaaaggtttattcattactttcatgcagagagataacatatcatcgcgtggggatttattcaatccaaagaaaagcttccaaaaactgactttgcttcatgaaacactcactctaatttgcttcatcaatcttaggactgacttttccaaatcaatatgcgaactatcttctaatttacattggtttcgtgttttttcgaaaggagacaactatctttttaaaagcttttctatagtgtgatgacaaaaaaaaaatgtaattgttagttgcaaaagaaaagtacaatagtcttttctagttttgagagtttaaggtttatgatcggaacttagagtttaaatttaaactattttgttaatttttggactgataacagtttttttttgaaaatattgaaacgttgtttacctaatgtaacatgttattctacttaaattactttatattttaataacatataatattgaataggatatcataggatattattacgtaataatatcctatggtgtcattttataagttagcacaagcttgttttaacttataaaatgattctccctccatataaaaaagtttgattttatagaatgtttataccgattaaaaaaataataatgcttagttataaattactatttattcatgctaaactatttctcgtaactattaaccaatagtaattcatcaaattttaaaattctcaattaattgattcttgaaattcataaccttttaatattgattgataaaaatatacataaactcaatctttttaatacaaaaaaactttaaaaaatcaatttttctgattcggagggagtatatgttattgcttagaatcacagattcatatcaggattggaaaattttaaagccagtgcatatcagtagtcaaaattggtaaatgatatacgaaggcggtacaaaattaggtatactgaagatagaagaacacaaaagtagatcggtcacctagagtttttcaatttaaactgcgtattagtgtttggaaaaaaaaaacaaagtgtatacaatgtcaatcggtgatctttttttttttttttttttttttttttctttttggataaatctcaatgggtgatctattgactgtttctctacgtcactattttacttacgtcatagatgtggcggcatatattcttcaggacttttcagccataggcaagagtgatagagatactcatatgcatgaaacactaagaaacaaataattcttgactttttttcttttatttgaaaattgactgtagatataaacttttattttttctgactgtaaatataatcttaattgccaaactgtccgatacgatttttctgtattatttacaggaagatatcttcaaaacattttgaatgaagtaatatatgaaattcaaatttgaaatagaagacttaaattagaatcatgaagaaaaaaaaaacacaaaacaactgaatgacatgaaacaactatatacaatgtttcttaataaacttcatttagggtatacttacatatatactaaaaaaatatatcaacaatggcaaagctaccgatacgaaacaatattaggaaaaatgtgtgtaaggacaagattgacaaaaaaatagttacgaaaacaacttctattcatttggacaattgcaatgaatattactaaaatactcacacatggaccatgtatttacaaaaacgtgagatctatagttaacaaaaaaaaaaagaaaaaaatagttttcaaatctctatataagcgatgtttacgaaccccaaaatcataacacaacaataaccattatcaacttagaaaa

SEQ ID NO: 4732 - DNA, 2000 bp, Arabidopsis thaliana
gttgaaatattattttatcaatttgagtgaaaatgtggaaatccactattctatcgaagttccaactctaacttggtggaaataagttgtataggataaaaccataatataatgggcattgtattaataccaaaactgatcccattccaaaagaaaaaatggaattttacggtggtattggctatattgatactttacttggagaaaaaaaaaaattgattgaaaatatgactaatattattagtcggacagtcatatcaaaatggagttgaaaaacaaaaatggctaatttggtaaatgctccatcgagattggaagtaagaaagaacatcttttcatgatttttaaattgtaaataccgttagtgagtgttttctttgtttagtcaccttgtgttacaagtcctttctataagccactgatcgttttgtataaataatcaagaaatgcaaggcagacccataattattttaataaacaattatcatagtcaacccaaagtacttccaattccagctatggttaagtttgacttcacgataagtttcacctcacgcttaaatatatatttccatctatcttttctttttgttaaaggataccttcattatgggttaaaaaagtgtaactgtcaatctgtaaattttttattggatacaaagaaaatttatattaacgacaacaggtatgtttaacacatgagacgataatcaattccaaatttccggtaacggcaactatgtcctaagccacaccttgattgagtccatttaccacaatttgattttttttttttttttttggtttgatatttagtaatatcaattcacaataatatttatgaaaatatcttaacatacttgttatcaatgctgatccaacgtcttaaccaacatacctaactgataactagttccagatgaatagtcgtccaacccatagcacacgatattacatgtacaacacatgattcaaaataaatcatactggattttgcgaaatgtttaccacgtatagctagaattttccaaaagtttttaaaaaatttgtactttggagatttaaatcctgatatggcatagaaacatgaattctttttaggccaccaccaaaccaaaatcgttttaagtttttatgtaccgttttcgtcagaaattaactcactgagtaacatgttggctctataattgtttagttaaaacaagaactgatgagaatggaatatcaatcattaaatgaccgcttcaattttacctcggtttatcgcttggccactattttatttccgaaacccaaaagtagataaactagtttcttttgcatggaaattttttccaccttactttggttagagattcttttacttcgtttttctttaaagaagattttacataatctcattcaataaatttatgatatattaaaaagtatctttttcagttcaacatcgcagacattcataataactgccaaaacccatttctttgatcgtaccgtaaaatgtgaatgcgaggcatgaataaatttcggtcttttaaaaataaaaataaaataaaaaatttcagtcttcatcagaacgaccgaacactacatttagtttttaaaattgaaaaaatcgttttaaggtatgcatgacccataagaagtggtagctaagttcacacggcattaccagtctcctcatgccacttcatctcaagtcgttatctttgaattagtcaaagtcttcgtttcccttattttttaataaataattgcggctttcacttgtttgactttctttttattctctttacaaagaaataacaacaactcatgtataggcatcttgtttttaattgaattatgtatatatagagacataacaggaacaaagtccatatcactttctttctccttttccccttatcgataaacttgcgaaaccctaaaagctaagaaacttaagagtttaaagtttaacaaaaacaacttaaaaagagttttgagcagtgaaatta

SEQ ID NO: 4733 - DNA, 415 bp, Arabidopsis thaliana
gaatctgctttaccaacttagttctcaatttcttgagcttttttttttcttctttttattggcttaatacaagtaaggttgttgacttgttgtgatggaccaaagtcaccaaactggtctgttgagaaataaaactattgtttttgagttttagacataagagtcgtgattctccttctttcttgttttgttatctttaaatattatattctacgtgctcttcaagtaaaggatgtgttgaccatttcaccacccaaactaatatcttagaagcaaaagcattgtgaaatttacttgtagaacaaccttctcattcatatataaaagcagacaagcattagcatcatagatacatagagagcttaagcaaaagatctcatactttcaagattgatcgatctctcaagtctcaaca

SEQ ID NO: 4734 - DNA, 1608 bp, Arabidopsis thaliana
ccaaacgacaccgtttagctctgttttttaacctctggtaatttataaatttaatccctcgtttgtttcttttgataatcgattggtgtggatttgtaatttcttgatttgaaaatgtatgtctactgtgtgtaaatgtgcatgtctcagaatttgattgttttgcgtgtatctgactttatatacttgggtttaaaatcagaatgaatcatcgtttttgcatttacattgaaaaaatatcaagaagagaatttggtagagatcatttgtttgttttgaagttttcttttgtgatcaatgtttctcgatttacctttttcatttcatttctgatctctgcgttcaactattaaaaccggaacagcatcagtttcatgttttattttgtcaatgtgtcagagatcctgtcactttagatttcatagtttcaaaagtgattatttgatcatgtgggtccctgctgtgagaaccagtgggcactggcctttagtttggttaaaagcaggattcaaaacttcatactagtttctttgttctaaaatgtatttagcctttttcaaactcaagttgcacttgttgtacaaaagacacttttcttttgaatctaatttaacattacattcaaaaaaaaaaaaaacttcatactaagtaaatgtcgtgtttgatccaaacttttcccaatttgtttgcttagcagggtgcaatcttgtttaaatatctttgtcatgtataatgtgattccatctcttcatccatatagagaaaatcttgtttaaatgtcttttgtcatatgaccatattctcacttgggtttctagaaaaagttttgggttctttgagtttgttgaattggatctccttatggcttagaccgtcgttccaactgctgaagaagcaagtatgttgactcaaaacagtcacgttatatctctgtctctttgataattcttggcttttatgtgttgggtgcctagtatcatttgttttaaaggtttagggaacaaaaggtcataaactataataagaatactttttacaatgttatttcctcagcaaaagtagcacgcattcacattctccaagtttcatcatttgttatttatgaacgcaaacaaaaaaactgtactattaacaagcttttgttaagaaaaaagtaaggaaaccctcttaggatatgtatgtttcaacaataagcttatatctttactcattaagcccactagacaactttgtgagatagatcttataagaagcgtatcactttatccccgtgattacttctcaaaacaacgagttttgatttgtgctactttattaaattcacgttctgttttcagaaattttgttttttctgataggttcgtattgaaattgacctctttggaaactggatctttcataagatagaaagagaggtccccatttcccaagtttatcaaacaaaaagaaaaaaaaatctaaattgttctcatcttgagacaaccaatcagaatgaaccatctgagtcagccaaagggtttaatagtcaccatttgccaattgtattcatactctttcctttttggtgcgttattctaagagccctagtcagaattcaaacatttggca

SEQ ID NO: 4735 - DNA, 969 bp, Arabidopsis thaliana
gaccggagatatccctaactaagttagttgagaaatccaaacgaaaaaaatgaagagaagaaaaaaagcaaaagaaagaaaagtatagtttggcggtggagtacgatttaggacaaagaagaagaagaagaaaaattggtactttccaaataaaaaagtattttaatcattaactaaacaacattttgaaattaatttaagactggctagaaaattatgtactatataataagattccatgactacaaaaaaaaaaactaattaaatttcaagattgtaataattatttaaaaagaaaactgaaataactgctagaatacacttttggcagctgtaaattattttcacttgtataattcattttttcacatgaatatgcattgtcacattattaggctcatttttaacatttttttaccgtctaatgtagattttaacaaacaaacaaaaatcgactctagatgataatgagtaatgataaaatcatcagttgtcataaattgtaggattcaaaactgtttttgatcacaaatatgagagttttccttagatacaaaactagtaatcactgaactatcatgcatgttgttggtattttgtattttagtctaaaatagttaaatttatggaaaataaaagaattcatgtttgtctcatcattttgagggaccgaaccgtaatttcgcagtaagaaacataaatatcaatcttaattcctcaagaattctacacctcccgttccatctatcacgaaaacaaataattacagtaagtacccccgaatatccttgttcatccgaagcaattcgaggataataccgtctttttctctttaaaatccaattaacataaaataaatatttgctcagtccgttgagacctcacacacactctctctctgatcattcaacttttcgaaattttgcttcatcgtcttcgtcatcgtctctctgttgaattcctcaaaca

SEQ ID NO: 4736 - DNA, 374 bp, Arabidopsis thaliana
catttcctttccttcttctctcctttttaccctttcttctctcgccctcgtttacttcttgagattttcttagctcgatttgatctttggtgctttaacttctggcggtgtttgatttgcagcacaaaaaggtgattttttttttgtttctttgacttctgcaaatttaattctgttcaatttgggatctaaacacatagtctatgttttaattcatgggcttctataatatcatgcgagtagagtgaataaaatttgagcatgagtctttgttttcgttgtgtgctctaaagatcatatttactgatgataactttaaatttgtttgtgcagttactactactactgtgattaccttgtactgttagttggat

SEQ ID NO: 4737 - DNA, 2000 bp, Arabidopsis thaliana
gtattttacaaagtctccatattctatacattcaatagatattcacctaaatatagtttgaattatgtgtcgtctagtgcaataataatcctaaacataaaacaagagagcgagagatagtgaagaagtgccccgaggattcggcgtttggtcgtgtggtctttgttgcaaaaacaggttgtgtggctctctcccttttatctccttatctctcctcttcccttttccacctcttatctttcttactttcttatattacaatatccctccctaattccattatatattttgttttatccccaaaccttttcaaagtcaactccgtctcccaccccactctctcattatataaatatatattttgccaaaaaattcgtgatggatcctaatcttcgtggatcagaatagtaacgtgcagttcaactgcggataaagtacaatgcagttctaatagtaacgaaaatatctacatacactgcaccgcacaatgcggttcgatcaccgttcggaaccttttttggaaacaactttcctactaagtggattcgaatcaaaattctcatctttcaaattaactattagaccaagaacctcttggtttatccaactatcatccttttttcattctgaattttacagaaaaaaatgtggtggctaagtaaacataggttgcatgtatgcatgacttactaatactattatcatggttccaatttttttattttatttcgactaatgtttttaagtgctttcatctttaaacaaaatctgagccttgtaattgaactcaattatatagttttggtaagaaattaactatgaaagatgatgtctagtcaaaggataccaagcttttaggagatgtattggaaaatgatctgagttttagttgagtttttatatgattttgatgattttaggaaagttgatacgaatttttataaaatcttttcaaatttcatctaaaaccgtataatttggatttctatatttttaactaaaatgtttttctcaaatcttctccaatctttcaaaattaataagaatcaaattgacaaaccgttttcaataacaataaatttttaaattattagtttaataacactaaattttattattaaaattattaaaatccataattagataacataaaatttgtaaattttacacaaatcacttaaaatactagattaaatacactcttcgtcaataaacaaatttagtaagcgggttatacggcgggtacactcaccaagagtttttaagaagattagtcagtggtaagagagtcttgatctctgattaaaaaaaaagagtgatttgattattattattttgaacacgacaaaacaaactaatgtggaaaaactgaaaaatataagagagaagaagggcaaatatgcaaaggtaacacaaatgcattgtgagccatacgtaagctcaaagatttttcacgttgctcttatctgccacgcggccaagattccaataaggcaagctacttgattgggataaactaaataacaaaataaactacttacaaaaacatcatgtaatttaaaataaataaataaaataaaaaaaagaaaaagaagaagatatattaaagaggtttgtgaagacgaaggagtccaaaacctccctcaggagcttccgccttattcagaggttaaacttctctcttccttgcaaatttacttcttcgttttctccgcttgtttgtgtctatgatcttgcctatgaaacatctttttatagtacacatatatgttgtcttattggaaatatgatcggctaacatatttgttattgttattaacaaaaaaaataacatttgttattgttcaccggagttgatagtagcaatagtacatattacatggtcatatatgcatatggctacatgtttgagttatattcgattatctggtgaaagatgagattgtgagtttgtaagtttttgacagtgtagaggaggatccaaaagaaaagaggaaaaa

SEQ ID NO: 4738 - DNA, 1430 bp, Arabidopsis thaliana
gaggggaaagacaggcaagaacatctctgtgaatttagaggtttaatagtgtctgtagattttgtgaagtttcaagagtgaataactgaatagtttagattttgtgaagttgcatgcaaagaagaaaacaaggaagagctcttgttagtagtttctgtaaatggtcttttattgggactaacttgaaaagcttaaaggctttgatgtgttggacaaggaaaacaatgtacatatacaaatttgtgatatcatgtttttttttttgtttcttaaggtgattttactgttgtgttttgtgttctaataaatagttagtcttataatttcaatccaaaagttaaggaatgaaatagtatgaatcttttttggtgcaaatagttcagtttgttcagcaaaaaatatttgaatgaatagattatttataattatttttttgttcaactcttttatactccctcattatcacaccaattaagaagaacattcaatgtttagttataaatgtactatttattcatactgaaccatttctcataactattaaccaatagtaattcatcaaaattttaaaattctcaattaatgatttttgaaattaacaatttattgataaaaatttaaagaaagtcaatatttttgatacaaaaataaaacctcagaaaatcattctttagtattcaaattttggagagaaatgagttgaatgatattccactttagcttttctaatttagtttttacgatcattcatttagagacgaacatttacatctttaatatttgtgttacggttattaaaacttgtttgttgtgaaatagtttgaagatttatttaattatttattatgaatctaaaatcattatttataataacataaaaattgcattatttgagtaaatgataaaaatgaaattttatctagctgaattaattttttgtcaagttgctattagttaattcgttccaaaatatctaaatcatgaaaatgtctaaaacattctccatggtccttccatagaaaaaaaaaagacgtagaagtgacacgtgcgtcaatccaaccgttaaattgacgcaaaggagaaaatttaatgattcagcaaagtttttttgttgtcttgtctctatcgaacccaagcgcactttagcaaccaccgccatttttcacagatgcttctcattgacacagaagaactcagaagaagtagaagaagaagcttctccgatctctcttctctcatctcgatctgtatgtgttcttcttcctctcgtcttctttctctatccagattctcaacaattgttcgtgtttcttcgctgtatctaacgatttagctctcctctctctgtgttcgtcgaacgattcctaatctgaatcatactcagtgaaatcaagcgatctagaagaatctggcaaaatcttagctgacga

SEQ ID NO: 4739 - DNA, 2000 bp, Arabidopsis thaliana
actattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtagaatggtgtgtagggcaaggtaaggatgcttcacttacaaaagaatcatttagaaccgtttctttctttgggatctaaatgtgtttttttcggcttatcccattggctttgaaaaagttctctagtttgtttctttgtactaggagcattcttaccattctttaaacattgggcagtgaaagatattttcttggattagtattctgcttcttgtggtgttgtgtgacactcctagactatgttatttcctgttaacactgtctttgtaggacaggatgtgagaaatatgctgtttctgcaggataccctgaatttaccagtttaccggaatcatatcagaaacataaactcttatgttacaaaattgtaatggattagttgatgcgcattctgtgttttttcagttgtaaatttgcagaattgttgaatgttgattgctcgagaagagtcttgtgagtgaattctatttcttaatatatctgattatcgtttttgttgttgatttaattagcag

SEQ ID NO: 4740 - DNA, 483 bp, Arabidopsis thaliana
atctcaccttcttgctactcaattccttaactcaaaatcaaaaatccaccaccaactagaaaacacagaaagagaacgacttcaattgaaagctttgaatagctaaacaaacccacaaagaaaaactcgaaattgaagaaaatttcagcaaaaaaagttgagagagtaagaaagaagatacctccaatagaaatttgctaaaaccctaaaagcttgattagtcggcgacttttagtcgtggagaagctcagatactttagcgtaattacatctataccctttcgtttgatgacgtggcgtgtaatgtctcttaaaccctaattcggctgtgtagcaaaagagaagcctttgttgtgttctttacctctcttcacgaaatcccatttgagaaagtaaggatttatgatcttcaaattcaagtatgaattataaagtttcgatttttacgaatcattaattttgtattcaggtactgctaaaaaa

SEQ ID NO: 4741 - DNA, 2000 bp, Arabidopsis thaliana
aaaatcaacaagcacccttcaatcttcttagtaacaataaatatgcatatcacaattctataattatgcttaaaagaatttaattagaacatagtgacatcgttctctataaaaaattatgtgatattgtaatgtattaaaatgtacttcttaaggttaattttgcataacttaaattttaaattcattgttttttcctaattgaaagagaaattttagctaaatttattggactagtgttagacatggatactattattttttgaacaatgagatgaagattcttacatgtaataaggttcccaaccacaatttcgaaaaaagtccaaatctttattgggatcaagtgttgcaacataattcaccaatttcaaagaaaaagctttaatcatgtgatctaataagggttacaaatgttgtagacttacatttttggagaagtattcgtgatctattagtagtaggtgactgatatgtttggctttctttttctgaaagatcagatatctgccacaataattttgtatattttcatccactgatactccagcatagtagcatgactatattcctcaacgttactctttgactctacaagttcaaccaaaactcttaccttcatttaatttgatttctcattttgaatggcacaaatacagatggtggtaatttagaaaaaatataaacttgttgagactgtgatctataatcatcttatggatgatccaagctgtagacaatagtctcattcctagctaattgttcatcattatcacaaatatttttaattaaacactcattttgtatttctatcaaatgcctgaaaaatgtgcttgtaatttttgagttgaaagcaattcttctccaacattcgcttgatctaaccaattaatcatcttttgtaaatgagtctaatggaagcttagagagcttagaaaatattttttcaatcagtgattttgaaaataaaaataataggttagagcaaatgtatttatattcaataacaatttaacaaataccaagataatatataaagttaattaaagttttcagttctgcttatttttgagcaaatatagtgataataagacattttactttttaaaactcggaaaggatgcgttgtttttattaaaccttaaagtggtatttaaaatttcaaatattttttaaaatttataaacgaaattcaagttttgagcaaatttgtttttaatatacgatagaatgataaataagtataaactgaagtatacgtaacttaattctgctttgtatcctttaaagtgttgctaattgttaacagctcattatttgttcaaacaatattaatttatgtatctatattttaagaaaatttatctataatatataaaagaaatatattcattctaatattatataggaattgacaacaaaaagaaatcacttattagtaatatatcaaaaattgtactaaatttattttttatgaaatcggatccggtatgcttgcttagattatactaatactttataactaataccattgtcaaaggaggaaaacggtgtctgagaaaaaaaaaatctggtttgttaataaattccatccatgtaagagttattattgttttccaattcatcttcctacgaaatttcgaagaaatataataaattgcgttctcttctttaacacatgattcaaatattcacagcgtagttaataattgaataaaccacaagttaaaataaaataaccttttaatcggttgccgtgtagagcccttgacagtcatcgtttcgtttggataaaatcgcaaacttctacgaaatttccaagggcatttccgtaatttcgtagaaaacggtgaccaaaagaaattaacacgaggaggttgaagtctatgtctatccattgaccttcaccaatatataaagaagcaaaacccaaagcctaaaagaatcttaaaactttgcttaaaaccaaaaacaaagtttcatttcttcttcttcttgaa

SEQ ID NO: 4742 - DNA, 863 bp, Arabidopsis thaliana
catttcttcaactttttagttcaagaaggccacaatgttacccagcccaataaacatctgtatcccacaaagcccaagaagcaacctgcaaaacaattacgcaggaaaattatgtgacaaatcaccttttctaatttctttcctatttttccgtaaagcaaaccgcctagctttaaatgaataattgacccgaaacgcacgcaatgtcccacgcggtcgaatccgaaccgttgagatcttatctaaccgtttaatcgagaccgtccatctcttgtaaccctctatatataagagataaatcctgctagggttatctcatcaccgcctccatattctttcgcgtcttttgcttcctccctctttttcgccaatgttttctttagatctagctaatatggcgacgattttgttctttctcgcttctaatcaccgtagagatcctcccgatctgcaaatccgatccgaattctcaacgaatttgtagatctgatctgtgattccatcgttgacgacggatcttcgcttacatcgtttgatctgtcgcagatctgccgttttctataggtaaaatctttcctccttgtaccgtgagcttttcttatggtcgttttccataaccttgttatgtaatcgcgaatattgttcttgattatcagatctagatctggatcgtccttcgcggcttcttcacatgcaagattctgtgaattgttcaagttgaggcatcatttctggattactaggagacgaatctgttgcagacggatgtgtgtgtgttggattgaattgagattagggtgtagaagatgttttgtggatagctaatagcttcctgattgcatctctgtcatccgacctttgcc

SEQ ID NO: 4743 - DNA, 2000 bp, Arabidopsis thaliana
agcatgacaggcacagtacactaatagtctagtcatcacgtagtaatcaataccaaaatgtcacctagtaagcaaaaactccatgcaatgtctatatcgaagaaaaaaaaaaaaaaaaaaaaaaagcatgatgaatttaacgatcattgatagtaacacagtgctagtctttgttagcatgagtcaaagtcatcagtcggttcatccagaatccaacgatctcataatctactgacccggagaataaggctttcaagtcaacataagtcaaccaacattatattaggcagctcaactttaatatcattcttgactaatatgaattcgtatttgccttttaccaaaagaaaggatagaacatgtatatctcttaaaattcagattttgtggtcattcgtttattcaccaatgaatcttgcagcaaatgttgaaaccacgtcaacttacggaaatttggaaataatgtttcatttaaaagaaaagaaactagtaaaagcaaaaaaaaagaaatacgtgaaatctagaggtcattgattcgattggtacttgatagaaaaccatatcaaatacttcagtctccgatttaagagaatgtacgggtttaagaacaaaaccttttcatagtttaaaaaaaaaaattaacaaaaaaataaataaaaattcaaatgtcttctatatattcatcacaagacttgagatgaccaaaaacacgacgacaaaaaaagatgacttcgaagtcaccaaatacttgtgttactattgcttcttaattagaacacattcattgatgagagactcttttgagtttcttaaaattacaatatttaatattttaatattaaaaaaaaattaagcagaaaaagatatatcgggccaaagtctctcaaacatgtttttttttaatataatgttaaactttttttttttttaaaataacgtttttacaattagtgcatcttgtgtttgaaaatcgaatctaaaaaaaacagaatatatgaattgaacacacaactctaattattaagaccgactccgaaaccagctttggaagcaagcttcataacgtcgatcgtttcttctctcaaataggttttaaagtctcctaaacaagacacgtctatcattttctctcatgcttttctattattttataaatttttaaccttcagatactctctcacataccacaattgaagatgcccttatacttatcactttttcctctcgacttgggatcgtggaatctgcttgccgctttcattaagtgtagaggagtagaagagattaaaggagagcatagatattgggttttgagctttagagagctctacttttctattttttttgtttgtttgttaggaaatccattgaacaccatcaaggattagaagagatttttttttagtataattctactaatacaaaattaagcactaaagtctaaaccgcactcgcaatattttatattcacagtaactataagaagcgaagctaaaaagaaaaacagaaaaaagcttgatgaccaattcaacgatcattgatagtggcaaagtgcgagctgagtctttgttatttgctttcaacataagtcaaagtcatctgcggttcatctaaaatcaaacgatatcaagtgacactgaaaataaagtgtcaagtcgttgttactttcttctttctaagtcaacctacactaatagtcaactccacttaatatattcttcttcgactaatatgaaatggcaaagaagtcgtatttgaatttttccaaaaaaccaacggacaatgcacttatctcttaaaattcaaatttgtaaatcaataaaaaggaatcttgtaggcttgtaggtaatttagaaaccgcattcacacgtgaaactttgaaataaaactaaaagctggtttacaagaaaactaatagggaaaccaaaaatatgaggttaggcgtcttctatatatatatcacaaacttgcaatgaaaaaaaaacgcaactaaggagaaa

SEQ ID NO: 4744 - DNA, 1823 bp, Arabidopsis thaliana
cgtgtgaaagacggataattctacagagacaatgcatcatcccattcggtcaggtcaattttcatccctattttgtttataatctataatcttatagatagtttaattacaaaaaaggtttttatacttttgatttttcaaaacaaaatatatttctcaaagttttgatttttaaaagttttcaactcttttttatttttctttttttttataaatactaaattaatatgacattttgaaatctaaccggattttggatcccgccatttaaccttggtcattagcgattccacaaatccaacaagtttttcacatcttcatgtatatttagcatttatttttcttaaaaagttttcaactcttttttttttttttttaaagttttataaatactaaattaatatgacgttgtgaaatctaaccggattttggatcccgccatttaaccttggtcattagcgatttcacaaatccaacatgtttttcacatcttcatgtatatttaacatttatttatttttttaaaaattcaactctttttttaaagggttatataaatattaaattaatatgatgtcgtgaaatctaaccggattttggatcccgccattgaaccgtggttattagcgattccacaaatccaacatgtttttcatattttcatatatatttagcatttattttttattttcttttcttaaaaggttttcaactctttttttttgttttaaggttttataaatactaaattaatatgacgttgtgaaatctaaccggattttggatcctaccatttaaccgtggtcattagtgattccataaatccaacatgttttcacatcttcatgtatatttaacgaataaattgttaaatttttagattttggtgtaaacaaataagacacaacatccaaacccctaagaagtgtccttggttcaatatagcttacatataatttagtaaactaaaaacaaattatttaaaattactaaaaaatgtatttatttttatacgattttaaaattatatattcatattgtatatatttggataagtgttaaattttttgatttcatttaaacaaattggacgcaacatcaaaactcctaagagatgtcctcggttcaatatagtttacatataatttaaatttttaacaattgtttttatttttctaaaagttatttttaaaattatatatatatatatatatattgctattaaactataaggtttttttggataagtgttaacattttaaattttgtgtaaacaaattggacataacatcctaacccttaagatgtgtcataggttcaatatggtttagatgttaaatttgtaacccttattttattttattaaaaatgattttaaaattatatttttatattactattaagactagatttttttggataagttttaaatttttaaattttgtgtatggtttacacataattttaaatttgaacacttgtttttctttttaaaaaaatgttttgaaattatatttttatattactaattaaagtaataattctaaaaagaaaaattttaaagaaaaaaaaaactagcagaagttttgattatatgatttgaattttgatcattatggatattcacgttttttagtacataggtgataggactagaaacacctaaaacacttatgattaattaaagatcatggtatgttttatattagtctttcatttatctttattatgcttttttattattattcaattaatatttgttcaaatttgagtgagactgataataaagagattcaagcagaagaaaataaagtcaaacaaaa

SEQ ID NO: 4745 - DNA, 2000 bp, Arabidopsis thaliana
gttctgaagattgattaaaaaaaatctgactcgtcctagcatgataaccataagaagtgtttcttaaaaatgtaaggaagacaaggataactgattaaaaatctgaattgctctagctagataaccatattaagtccttattaatttgtcaatgatatatagttttacaatacaagtaagcacttaccatcccaccaagttcatcctcttcatccagtctcgacatctttccattcacattaaactctaaatctacttcatcctgaccctatgattagagaagccaaatacaaataagaacatcatattacggtacatgcatgtctcaagaatcaacactttttttgtttatttcttgaaaataaaggaaacatacctctttctgctgctgcagacgttttaagtaagtagactgttttctgcggagctccatggaaaggttctgaagatctgttgcaagagaacgctgtcaaaagcagtatgccaaaaagtaggtcaagtccattggagagccccactatacatgtacacagaactttatcctcatgctacaaactcaaaacatagaataacccaaagtacattatatagagggaaaaaaaaacacttcatacattttgctgactgataatgtcaactagataggtagtcaaaacatatgagagtgatttaacccaaaattcctaactttcttctctaaaagcacaaaagaaaaggtaatgaccatgcattctttattgttaacaagctcgattctgaaaaagtgtccaacaacctacctgcacatttttcctgagatttgattcttcagaaggccctctagtagataacatctgcaatctcttttctgacttcctcaacaaatctgtgatctcatgagtgagcatctcgacttcacgatgaatccctttgttatctccaaatgtaggcataagagcctttgaatgtgcctttgctagttcattcattttgtctcgcaccttttgtatattaaaagttatctcctcagaatcatcaacccaagctggtggcataccaattgtgaaggcatcactactgcaaacattcacaacaacacttaaatcatttgctcattctgttacctaattcgtttagggttctaattctgtatctcaaatcaatcccatgattacaattcgtttctatatataagttcatagaatttcccaggttttgcagaatcaaacaacacattatattattaccttgatggaccaggatcataggaattcaaaggagcataagaggagtgattggaccgggaaaatgaaccgctaaccatttcgatcaccggaccaccgaacgaatcagacgccgataaagataatggagcacgcgcgctcttacacgcatccctgtgtttccggtacaccgtcgttcgattcctcgtcgccatcaataccaaatcaattgattctcaacagaatctcgaaagtaaaatttcccggagaaaataaacaaaatcggagcttttgtcgtcggcaaaagcaaacgaatctgaatcgcaaaatcgtttctcattagcgcgtgttacagacttagcaacgaaggagaagtatttgggcctttttaggcccatttatatattgggcttatagtccacttgcgcgatagggtcaatataagtgtgtggagcacacgttttaagacggtggcgcaaagacgaaaatgcccgtagattcgtggcggctaaaagtcaacagagggacgttggtggttcagggtaaaagaggctatagtgaccggttaggggtagtttggtcattggatttagctcaatagattcgtgtccatggattccctcatgtcgccagagaaaaagaccacatttaaaggtcttgcctttttggtgtgtttcctcgcactttcaggctgaacaaagtactgacagatgctaataaatacacggaggaagaatatgctcctttaattattatctgagatttttcaattcaagttcgtgtggattcagaatcaaa

SEQ ID NO: 4746 - DNA, 2000 bp, Arabidopsis thaliana
ggatgctgccgaagatacgagaattaggctatatagtattgaaacaaataaagctcaagtaaaagattctaaaattatttcataaatatttatgcatagtgcatccacatatacccccatctattgtacatttttataaatctttctcctaactcagtggcgtagagaatcttaattagattatagagccagtagtcccggagaattaaatttggttgtaaaaccgatagcataagctctctagttatgtagtccttgtccactgacaatgattgagcctgagaatataagttaaatctatcaaaatataagtacttattgaaattatgatttctaaaaccatacttaagtactcaaccgtacgcatactgccaaagtttagagaattagggaatccaagtgggtaaataaagacgcaaacacagctgagaaactcatttgtcttgtccgaatacagaacaacattattaaagccccacaaatctttagtgattttggaagttacacaaacttcttgatttggttcaatcttatatacgtatgggcaacaataaacgaaaggagtaggggtcacaatgatgaaaaggccaagaaactaaaaaaatgtaatcaacgataaaagccttaaaggaaacttcccggaagctgccttcttgaggatacgtctatgcacttctcacttgcatgtggttagatgttgttatcgacccttcttggttagacaatctattaatatatttttgtctttgttatataagatttctatactatatgggaatcaaagctcctacatgcatgtgttcttacagtcttacttgttatggcatttagcctaacgtggtcacaaaccatatgacgagtgggtcctctaatgtgtacggaataagaaacttatgttatcatttagatcatatcttcttagaaggtatcgtaatcatgcctcataaaaaatcatatcttcttccaaagaatcataatcataaatgaaaatgaccattaaatccacgaatataaccgcttattcatttataattgtttatcactcctgcatcaatctttgaacagatcgatagaagcatccgagatactctcttcactagcaaatatcctaagagtaagagatgtggttgattgcgtcttagtggttgatttgtttagtttctgtctggcttttattttaattcctcttttgccaaagaagtttcttgttaagtaatttgccattagaatttacatataaggggacgacgctgaaaatcaagctgaatgattgtacaaaattcaagatgaaaattgcgttctacttccagcaacctaaagaaaatatgcttaagcttgatgattagtgatgctcatataaaataaaacaaacatataaataatatgtgacctaatcacattatataaaacaaaattatatcacattattaaattccatcatttaaggtagcttgattttgttttatcagaatgaaatatgatttataaacctaatggagcaggtgaaccaccccaatgtgagaaccactcaaacctaaaaaagcatgacaactttaaaggtactaaaactgtattggaagttggaatcaaaattgtttattcactaaacgaattttcccctaggatcttctgatttgactgattcgtttagtatattgtttaatcttcttttttttttggaacaaaagaagaactgttgagtactagagaattaaaaaaaataaaaattgattctttgattatttttatttttttgtttacctgaattgattctttgattattttaagaattctttttaaggaattttggtcctgatgtgttgctttttttcagtagtgcgatctgacgactgtcacaaaggcataaaccctttatgcatggactaatcaattaaattaattaaatagcttctcttatttttcttataatctcgaagttggtcgaagcaaagcaaaagcaaaattctcttggccgagagaagaaacattgatcgtcgatc

SEQ ID NO: 4747 - DNA, 2000 bp, Arabidopsis thaliana
caaattgggaaaggagaagaagagtcctggagaatgacgattgtcgaaacgatatcgtattcgttttataaatcttaaaactttcttatatgggcttaaaagatgtgaataaacccaacacaaaataagtttagttttgggcttattgcttatcattaaacgggcctatcaacgagtgaaagagtcaaaaacaaattttatcacaagacaaaaaattcaaatagtcaaaaagaaagtgaatgctgaaacctaatttattttctcacatatgtttgaatacgaatggtggatttcatgttttcactctgccttttaaaattctacctttcattttctaatagacacgagttaatgacaaccattagctttatcattaactaagttgattttttactactccgtttaaaagtttaatgccaacacaaattcaacacagttttcagaaaagtaaatccactatcatagtaaaccattgttagcttggaacaattatatatctttttagagaaattagtctcaaatatgattgggagtgagacaatctcggatggttgtatctatttttcttttactgaaaaatagagatttttttttttatgtcaatgctttttcaaaagtaaaaatctctatttgttagaaaaaatagaaatttttattttttattctatatataaaaaaactctattttagagataaaactatagatgagttagaatgaaataaatacaaaaataaagtatagagataaaaatagagatgagttggaaatgatatgaaggaatagattagaaagaatctatatatacatttttgcagccattttcgcaaataaatcctagacttgtacttatttacaatctaatgccattagcattaaatcttttttccaaaataattaattttactttaaatttttgatttaaattgtcaatcacattatcaatcaaatttaatcccaacaaacttcaaatcaatctcttaaaattagcataaacatatttgttaacaatattttaaaacaaagttttttgttaaaataaatattattcttactaaacgttttttgtttaaataaataaattttgtatttgaacttatttacaatgtcatgtcactgacattaattatttattaatgaaaatatttaattaaagatttaaatcttctaaatccttacttttagagttattatgtcattactttgtaagcaaaaatattattttttaaatattattatttatatatttaaaatttataaaacattattaatatttaaacttataaaaattttgatatatcataattttttaacatcagtttaaaaaaatcttaatttttgccgtcatattttatgattcaaaattttaaaaatgaacatatattaaccaattggcaaaaaatgtgtgggttcaacgtcccgcatcgacaaaaatatttagacaataatttataaacatatcataaataagatcaacattaatataaataaatgggttttttacaggacgaatttgacgggacgagtttggcaggacgttacttaataacaattgtaaattataaaataaaaatatattatagatatacaatttgcaaaaaaaaaattatactaactttaaaaagataaattgtctccgcagtgtaccgcggattaaaatctagttagaaaacaaaagcgttgtcattgattttattctattttaatttatatcgaatttttttgatatttcaacactaagattttttcacattttttaatttaagaatcttgaaattacttattaaagaaccaaatcaaaatttctaaagctctagttccttgacaagtggcgttgtttaagattttaaataatcctaatatctctagtaaaataaaataacagccaagtacgacttttttgtattcactctctctctcaaagattccgtctatagaatcattttcacaattagaaatccgaacccaaactcatcaattttacaaattctctcttatctct

SEQ ID NO: 4748 - DNA, 2000 bp, Arabidopsis thaliana
taggaaaaaatctctaataccaattgcaatttttttgttgttgtaatattgcagtaagctctctcatttaagcctttgaacaaaaaataaaataaatatcagatttattgttgagtttcgcgttggtatttcaagaaaagaatatggtctttggcttttgaccaaaaaaaaaaaaagaatatggtctttggctctttgcgacgcctatatgcatatatgatatttgtatgactatagactcatagttaatttattttctattccattttaacttatcagtgtcactaatcaaagctattattaaacggtctattttaaaacaaaccattttgtctatatgctatttcatatacgacgattataatcgcttctttagaactaatagccaataataatgtatatttcgactgttcaccatacaccgccacctaattcttctaaaacatttcaattcattgactaaatatcgtcattattttgcttacacattttgtatatgttcctccaaatttgttcactagagttttcaactagaacaaaacaactactctgttggtgaaagaatgaatatgcatgtgtgaagtttattgctcaatatggatatagaagatgaaaagaaaaagagtaaattgatttctttaccaaaacgtgtccagatgttatgtcaatatgtaattctgacatgaccagaacttctgtaacgcatttaacaatcacttccgaaaataacaaaaacaaaattcaggaaagatgatgaaattgtaaaagacagactgtaatggcgtctattgagacaatgactcaatctgtcttaaaccggaaagttgactcgtaagccatattgattatctttattaaattttcctttttattctcttattctctcgaagtagtaactttcttttgcatcaaataaagaaaatatgaaaacgcacccctaaagtttatcttattttttttattagtgcctctagttttctaatgtgtagagtcagtgacacactttctttttactttatatcaagatttgatgatatcatatgattttagacttctaattaaggtttttgtaaaaattgtcacactacttttttgaattctttcactttttttaacaaatgttatttagaaaacatagtcaatatacagatcctaaatgtagataaaaatttacaattttgactagcaagatctgatttgatatgtttcttatatatcaatttttacccttatttgttccattttactttgatacttttttttatagacaaatttagataattttatttgataagtcatagcatttatttttcttatttttataccaaaatttattataaatacatttttcaaacaacacatatacaacacaaactgtcattaaaacccaaattttatatatatatatataccaagctggtaataatatgatatgatcgtaattagcaaacatgagatcatgcaataaaagacttaagacaaaaaaatgtgccacgctggtaatgcaaattttgtcgtggtgtgtagataaacaaaagtttcagacttaaatcaaacatacataaacgttaagggtcttacttgcaaatttgagttttaccggtaaaaaaaagagtaacaggaaacgtaaaaagaagaagaagaacgctcaatggagaaaaaacgtgtcccgaagtggcaaatcacgcgacgagtctcttcttcttcttcttcttcatgcgttttctccttccttcttaaaagctctcttcttcctcctcctcttttaccaatacatctattaactctctcttccctcttcatcaagtttctcgaggagagtgaagaatttggttttaattattctttgattaccctttttgtggtgtggttttcgttatttcgaggagtgataataataccgttatgagtcatcactttacatgtgtttgatcaattactcttaattcactttctgggtttcttcctttgaatctctcctcaaagaaaagaaaagaaaa

SEQ ID NO: 4749 - DNA, 2000 bp, Arabidopsis thaliana
ctgtgcttattctacttgttttattgcttctttcattttttgtttactcacatcattgtttatttatttgtttgcttatatttaaatctatacttctttcattgtgtataaaagattaattttgaatttatacaaaatttactcagataattttgacaacaatatgaaaaatcaaaacactaataaatgtctgaataaccaaactgaacccgaaatataattactatagactggatgtagccaaaaattattattataaatccaaatatatcaaatattatatataaatcaaaattactaaaatacttaaaataaccaaaaaaaatccaaaaattaaccaaagttttttcaaatctaaccaacttttttgatatttcgggtacccgaaccaaagtaaccaaaaccaaacctgacccgcatatataaaatacatgtatggaccctccaagccaaaactctaaaaccataatctaacctgaacttataggcctaaaaatgtatatgcaaacttataaaactttatataacatttccaaatttttattaactgtataataataacactttagctagagatatcccaaaaaaaaggtcactcggatggtataataagatcgtatctatctataagtggacctttgtggcttcattctcagatatagtagttgacacattatacatcagtttaaattatatattaactagataaggatccgctcgatgggcgggtatgcgattggtgcattatttatgtattattgttcgaatagaactgtgagattataataacatctgtttgacacaattaattaattaattaaataatatttactttaaataatcaataatttaatctattgtaatattatatttaacaaaaaaacatttatacaatcaatacttcggtgtgtttaaaactagaaaaaaatcagaaacaaagtttgaaagaaacagagtagtcggattaaagatgtcatgcgggtggagattcaaaaccgtagaccatcatcataatgatagtcgttagaggcttggattgagctgagacggttctagacggttttgtcgattagtttgatttattgagctaattgagagggtaactcaccgtgtcttcttgcattcctctcacaccagatatggtagagagtagtttggaagacataacgaagcagaaagaggttgagccaaggaatgcttgtgttatgaagtattgcggccagctggtccagtttgacgagtagttggatggaaggaggcgatgtgcaaaatctttccaaaccgttgaggagtaggggcatgagaagaacaaatggtctctaaaaatacacttttcttattctttacaattaaatcagtcctcattcccccacacggccacaccacaattaatctgttaacactttattaacgacgaaaaaactaaataaaaaaaatctctttatacatttgacaaaagttgaaaaaaaaaaaaaaaaaaaaaaagaagaagaaaaaggagggaggaccaaattatctcaagaaaaactatggccttgaatgttttgtagattttgtaagagtttttggtttttgtttttcaaaaacttatttttataccattcaagattttaaaattttggtttccctacaatttagaaaaacaattttgttggagtttgccattcatgattttagttttttagttttcctaaaatttagaaaatttaatttttacttaattaacgttatttttctcaaaaaccaaaaactaacttttttttgggttttgaaacaaaaatataatatcaaaaatctaaaacgaaaatctaaaatctataaactaaaatctaaatccaaaaactgaatcgaaatacagcatccattcagggcctttataacaaaaagccaatgagaaaagtctgaaggaagagaatcgtcaacaaacgatggctatacaacaagaataaatacatcacatttttcagacaaactccaatttcacagtgaaaataaaaaca

SEQ ID NO: 4750 - DNA, 2000 bp, Arabidopsis thaliana
ttttgcaatgaacatatatgttttgttatctataatcgtattttaaaatcaagtggtcgtatatatatactctaatacttatagtcatgtggaaattttttcataagatgtacaacttacttacgatgatatattcaaacttagtaggaatttatttggttctatagcctatatatagttgactcactcaaaaataaccagagataaataataaaattgatgttttttggtaatatttatgaagtatgggccttatttataatcacacgctgaattctgaaaccttataattagaaaacgcattcaaaaaaaaaaaaaaataacaataagaaaatctatatagcctagtagaacggtcacaaaaacccacaaaagtatcaaaaactcgtaaaccatcaacgtttgagctcattttgttgttatagtcaaaatcattcaaagttattttgacaagacgtattggtaccataataacgcattaatacacctatacatttataaattattttattagttatacacgatggtagtacaagaatacatgtattgtagtagaattttgtaatcaattaatgtcacaaaattcaaaccaaacttcaatgagaaaattcatgatgctcaactagtcaatgtgtatgttatacgacaaaaaaacatgcaatttgtcaattaccatcgatccaaaaaaaaaaaccctctaaaacgataagaggaacgaaataagtatggagaatggtgtgttgatttggaaatgttataatgaggccgagacagccacatggccctattgcttgtatgcatatcatctcatctcctacctctcccacacttctctttgtcatgtcactgtttaatttttgaatactcgcaccatctcgttctctggtcccatgatgcatcgatacgaatatacttgattgactgtttcttgtttgtttcataactatataccctactttaaaccctatttgatccaatattgatcttagatttaagatgatgtttcggtggaatatgaggttcaatcattgcttcatttgtaattaaataaaattttagatgatactgaaaaagtcacgacaatacagatttttttattacactataattgtttttcaaataaaaagattggagttcatgtattcagtctctgttagggtcttaggaaccttttgttgttgatattatacgataaagatataattagcttattctctatctttatgattcctattcctactgatgtctttatgaatctcataatttataggtcacataaaacatggctaatcagtgttttgctaatcataagattttatagatgtgattcgcaattttgtttcctacaaagcaggggtggttttctagatagaaagagataaacgtatacaatcattcgctataataatatatgatcgattaacaacgatgtttatagatatttaatcattttgctagtgagtatacagtcttagatctcgtcgtcttgtctttctcctacacgtcacatggtaccacttcatgtttctttttgcttggtaccactccatgtttttattatcaaattggatatagaaaaattgcaattaatttgtagaaggtacataaatgaggtcccgctccggcaaatgttaaagccgtagttattttcttgaaggcctaatgctatcagctgaagattaaaaaaagcccaaaaacatatgggctttggtattctttataagcccagtcacttggaatactagcttatattttctttctttaaaactcagttaatagttatgttcaaatagagagaaaatctaagatgtggtgggacgaagttgccacgtgccaatgagttgaccaatgaggaaactcagtgcgttatccgtagggataatcagataagcagaatctgattttgtcaccagagtgcttttatagattacacaacacacgttcgtttctttcttcttctaacacactctgagtcttgaaggtcaacaacgtcgagaata

SEQ ID NO: 4751 - DNA, 2000 bp, Arabidopsis thaliana
acactcgaggctttttttgaaagaggcgagtgtgtttcaaaacaagccatttggtgggttagaacccacagaaaacgtatacacgcgctcaacacgcgtttggtgagagtggttgtgaaatcgcccgagaggtgagagtggggtatgacatggaatgctctgattagcttataaaataaaaatagtagagatgtagctccttccttcctatgttaatatttatttacttctcttttccaaagtatcatttcatttcatgtacagtagtgaacagtactaggaagccgtttaagggtcaatttgaatattttgtcatttgacgtgcatagcttaacaataacactaatgtcatggatctggacaaaataattactttagaaaagtaattatttgcaaacgtggttaaacagaacaatatgttcaatttatatgtagttgtaattacaataacaaatttgatcatgacagtgaaaataagcttttatttttataaaaatacctaatctcttagtttttttttcctttcttagccaatggatgaggatgacacgataatgataatcaaagatcaacatggcacgctcaagaccgcctttagaagtcctctctaaattctttcttccgatctcctaaatatgttttgttttggtcaaataaattgataggtaatacttagtgattatactatttggtttttgttttatcattgactatttcacttttataaatcaaatacttatcaaaattgttctttccgtatgtattcatattttctaatattgtaaagatttgtttcacctaacatctgtacccatctttgatcattgacaaaatatatattagaatggccttagaacgtgttaggcatcttcctactattatcatattacctaatccccaattttattacattttttaatttctaaaagagcttgaatataatgtcatttcgaatatctctgttcatctttttttttttctgtgcgacttctgacccaaagccttcgacgattttttccaatctgaaaacttttgaataaggaacttagtcaatggtcaacaccttgctaattaaacaaagttccattgatacaataatgagatttttgtacattaacgctttcatatagtttttgcgattcaacagataatcttaaaattaaggagtcctattgataaagtcttgttcaaacgtacaaactcaatccacacaaaaccttcataaaatacgatataggaaataaagattgtttttgcgtgagaaaatactatatgaactcaaaagattttaaaacaatttgtattaatacataaacaattgttgtgatacacccgtgtaaaattttaagattgtttttttctgaaattcttcaaggaaacttatagcttaaaatctacacttcaaatactctgttttaaaggcattaaaaataactgcgtttcagaaaaatattgaaattttagctgatcttttgctacaaatttaaggaatcttggcacctgcagaatctataacatgttcattaagtaatgcaatagttatacaattatacattatttgcatcatacttatattatagtgatattaacaaacccatgttctcagcacacttttacgtagaaaaacataaaaacccaaataggaagaagccactcataaggataatgggtttatataattcacagcaaagaaagccatcgaactattcgattaattatccattctttttttttttagtttgaatgtataagaacaaagagttgttacgcatcatgacaatgtcttagaaaacaaaagaaatgaataaaaaagtaaaacgaaaaataaaaagtgaggatgaagttgttgaatgagttggcgaggcggcgactttttcatacattccatttacttaattcctaaagtccttctcacatctctttgttatataatgacaccataaccatttcttctcttcacaatctttacaagaatatctctcttctacagtaaacaaaaa

SEQ ID NO: 4752 - DNA, 711 bp, Arabidopsis thaliana
ttattttttttttgtttagggtagatgtttagatgttttgttttgttaccttgatttttgtgtttctctggtactatatatacaaacacatatctgtattactattatttgcacgatatatctttctttattagttctaagttataacaaatatgatatcttacatataaagatatcttataataaacgtactagagtactaggtatacataaatctatcggaattgaattttgaagaaaaaaagataaacattacgttggcttactttatatgaaattcaatgaaaatcacttagccaaagaaagatagaaaaaaatcttatgatatactctttgtgtacgtaatataactttgtttataattatttatcaacgcaatagcaagcattgccactaaaccaataagagagtgatcatgagcatgttgggaacaacactatccacttgttcgcttacgtggacatttttcactgccacgagatcttccactcccacgctgcataaccacaatctctacatatcttctacacgtgaatctagtttgtggaaatctaaaaccaaccaatctacactcgctgacgtgtctatatgttaatcttcccacaaaatggagtaatgaacactttactatataaacggcgtctccaattcaacaacatctcattctcacttacttcttttctttttttgtgttcttgtttagaagaagca

SEQ ID NO: 4753 - DNA, 674 bp, Arabidopsis thaliana
atacatatcaaaccccaatctctgacatcacaacgaagcttcatttttctgttattttctagcgacctctcaagcggaacaacttctgaagaagagaaattagtactaacaagagttctgtgagatgatgtacagagaattttgtagtgtttttttttcttgctctttttaaggttacgttgttgatgaatgaggcaatatgattaacgtcagtaagaagtctaaaactgtagtaaccaacaagttacttagccaataatttaatccctaattttacatttgaaattcaaataatttgggacaatctaattaatattggaaattcgaataatttaactaatattacattttacatctaaatcatagtttataggaaaaaaaataaaacattataaaataaagagtaaaaaacttaaatgggcaaccagaaaagaaatatggataaaaaagagatggaattagagatacttcaaatccaaagctgtttcctgattggctaatcccaacatctcactctctatctatatcccatctctgattctcccacctctcttctcatccacaaaatactaacataaaagtcaaagtccctgagaccaatactttcaccaaacagcaaaacaagaagaacaacaacactaagcaaaaaagaaaagctcaagccgagagagaca

SEQ ID NO: 4754 - DNA, 1037 bp, Arabidopsis thaliana
aatctctccttgtatttgataaatgaaaagatttgtacaaaactaatgtgaaataagagagagagatgcttattttgtcgatattagtacttttctttcagatgctttagttgcaattcaacagaaaccatacgaaaactattttcactgttagtttcgtcactttcttctacacaccgctctttttatctttgacttaagatagtcaaaatcacacgttaaggtaatctctctttatttctttaaggttacatccaaaaatatattagtacgagccatcaatatttttctaatagtgcaaataattatttcataatttcgaagttaattagtgaaaaaatttctttgttaacggtgatggttaggggtggacatccgggtacgcagatcggattcgagtaaaacctgattgggtacgagtcattcggatagataaatttatgatccaataaaataaatctaaaatattggttcggttttggttcggatcaattggctataattttcaggttcttttttggaatcgaaacccgaaatttcaagtaaatacttggattttcggattaaatttgagtatggagtaaaatttatatattcgaataaaatatttagatacgatcaggttcggattcgtattcgatttcaaatccaatttttcgggtcagttctgagtcggttactcaggttccggttcttttccactcctaatgatgtaatagaagaagactggcccaacaaaagctcattgtctaattaagaagaagaaacgaagtaaccaacggccacgattactccaacacaagaccaaatctgattggttgacattatagatcgtcgtaagataattggtccacgtcatctccgatgacatagttaaatttcttcgtcttccataaaaagcgactacttcaccatcaccttcgggcactggacctatttaagcatcctaacttcttcttcaaagcttaaaaaccagaaaacaaaaggaagctctctgttcaaatcaaaaagagagatcgtacgcaaaagtttccgat

SEQ ID NO: 4755 - DNA, 487 bp, Arabidopsis thaliana
tcatcttcctttgtctcaacctgaaactcttttttttctttcattgtttgttctcttttcactgtggatgtagataattgtttttaatgaaatgaagaaatattgatttgccttttgacataattttgttaataatcttgattacaaattttagtcagtgtttgatgcatagttgcatactgcagagttgagtttggatatggccacgtcagcattatctcgttaccaaaacgtaaggtccaaactcagataatacaaacgaagcagttctttgtcactctatcatcaacatatgaaccacaccaaaaaagaacaaaatcgtagataatgatcatgcaaaaccgaccgttggatcttactttcgatttcaaaccacataaatcttagtgactgagctaaaaaactgaaattttttaaaaggcaagacctcctctgtttccatattctcaccacagaagaactcttgaggctttctcttttctctacc

SEQ ID NO: 4756 - DNA, 1713 bp, Arabidopsis thaliana
tatttcgttcccttataaaacactcttgtaagttccataataagttgaattttgaggatgtatcttcatgtatggttatatcatcatttttttttttttcatcttatggttatatcatcatcctatgtaatatatgtattaataataaagttgggtgcgtgcatatcatgtgacattcttctaagctacatcacaatgtaacaaaattatttaaaccgtgaataccatgtgtaagaataatataaaataaaaaggtttaaaaaatatatttataagactatctaactcttaattatttttaataaattttaatcgataatgtatattaatttaatcacaaaaatacaaatataataataataaaatatatgaaacaaaaatcgtgaggcaggatgttgaatttattaaacaaatatattattagagtgtagaaattctgtatatatgtagaattaataggtggataagagaagatgagttagaatgttaatttaaagattaaaaagtaagattttggaaaaaatatgcatattgcatattctaacccacaacattagataagatttaggacaatttttgagtaaaccttcttttactttaagccaatcattatgcatgttgtacaaattataatttcatttaattgtaaaatttaaaatataaccactatttataaactcaaactgacatataattttatttaattgtaaaatgtaaatcttaactactcttttataaactcaaactgacatataattttgtttaattgtaaaatttaaactctaatctacttttttaaacccaaataaacaaataattttgtttaattggaaatctcaattttaatcacattttttataaatccaaaacgacatataatttttattaattttaaaatctaaatctaatatttataatataaactcaaactaacatataattttgtttaattgtaaagtctaaattctatatataattaatctaatttaattaaaatttaaaattatataaattttgtttttattattattatatgatatgatataatgattggcttaaattaaaggagatgaatgcaagagttaacccaaatatttttcttagactaatgtatatgaaagactcatcaactttgtattcaagaaatgcatttattgtgtgtcaatcctctaaagattctttccatacttacaaaaaggaaacaaataagtcaatttggttaatgatttgccaactaaagaaacacagttactccacgatttaaaaagtcagatattcttaaatttcaacacatctcatgtatctcctttttagcctaaaaattgcagaaaaatgttatatcatctttactcgatttagaacgtttctatccaaaatcttttgaatttgattccacaaacaatagaaagtctgagaaaagtttacaacgcatctttttagttttgtgacatcaaccttgcataattttataaatgtcaagtcgtcaattcattctcaattcattgcactcgtacggggtttggatttgacgctaaatgccattgtgatattgactaagaacagcacacaatagcaaaagaaaagagagaaaaaaaaaaaaaaaaaaaaaacttttagagataaatgagtaattatattaacacgtgttggtatctatctagtataaaagattagtcactcaagccttggccacgaccacacaaagtaattaca

SEQ ID NO: 4757 - DNA, 1600 bp, Arabidopsis thaliana
caaggatttaacacttgatgttcttgatcatccggttctgaacttaatctactatatggtaagtaacactacatcttcattctttctctttcttattctcattcattaactcgaaaaaaaaaaaactacaggtggtagaagtacttccatcggcactagtcctcttcattctccgaaagctacctccaaagagagtatcagctcaataccatccgatccagtagaaacctttgtcactgaaccatctcacacggtgagtatgatgctgtttaagagaagagtaaagattaaaaaaaaaattggggcaaaaaatgaaaggtgaagaagaaatcggtgtggaatctgcgtgagtttttggaatgcacgttcatataaatgattttacagcttttagttgttgtagcccgccgtgacttttggtttggtagtttatgtctgttaaaattataaattgctcttctgctactttgaaaaatctggtcagtagtacaagaggtttaacatttgttgcgtcgatggttgattgttatgttatgtttggtaaaaaataaacgaatgctcttctccagtttcctttatgcttttgtcaactgttacatcttcttctcctaatgatttgtatatacttaagcttttccataaaactaagtcccagtgaagaaagaaactacgtaaaccgagaaaaccaagcaaaaagagggtttacacaacataaaatgattaaattgagaatcatttgcattacctcggtattacatgggctggaaataacttattgggccttggacctgattttccaaaaatggtcgctcacattaatatttatatgtgattttacagtgacaactccacaaatcagccctaactctgtttttgttttcttcgacgactgaggtcttttctctctcgctctcgtcttcctcttgattctcttcttcttttctggagtttcgctgcttttttagcctgtaaaaatgacgaaaattttgtatgaatttgtgtgctgatatgctcgaatccacatgttacgcttgtgttgaataatcatatcatttggttatcgaatcaattctagttccaatttacaaaaatctatcaaactctttacgttttctggagtatgttgagcttgaaactagtgacatagatgaaacattaaaaaaacatggaattgttaagtttgtgaaaattggattcgtctttgtgattctttattctttgtctttgctgtgatatataaagattttgtatagaacaacaatttgggagatggagacactgaaattgctgtatttgggattattggcagataaaagattcatacaagaaaaaagcaaatttcgccactgatggatcctatggagtcgtctagtgaacaggtgatgagttcatctctgtcactttaatggcttttactattggtttatctgcttatacaatcaaaatgatatcatggtactgttttagatggtgtttattagcctaagttactgtaaaataacaaatgaaaaaacctctgaaatgaaattgtatttgttgtttttacttttaaaaggacattgttgaagagagtcaaaagctggttgactcattggacaag

SEQ ID NO: 4758 - DNA, 2000 bp, Arabidopsis thaliana
gttatctctccacgatctttgttggaagacaaaccaacgtcccacatcaaaaaattagaaaataacattctagtatataattacttacatgaaaagtcaactaaagcgtaaacatagaaaacactatcataaagtgctattaatatctgtttttcgtatagtgattcaagtccaactcaaaattagtttgaggtctttcgggaaaatgtccaaaaacaaatccgtgcgagcttgaaatttttgtataaagtagacaagtttacttgggtttcgggagccaacaatcttgccttcaaacaacttatttgtagtagagtttttggtcgctttatattgtcgctagcgataattttctgatcaagctttacatctttgctggagattcaaatatccagtagttatcttgagtttcacaagagagaattacacaagtgtgtcaaagactagctatagtaattttcgactagctcactcttgaatctcttttattacaaactaggtaattacccgctatattacaagaaaacacgggttttcaaactacaacattagtagcaatatactcgttaaagtagaagtcgactatattacgagtaatagccttagtcgctaatccagagtcgctaaacaaaatagtcgtaactttagtcgctaaatgaccactacgatacgactaatacccgctgtcataacattagtcatattgtagtcgtaaaatataacgactgagttacgattgaatcacataaataacgagtatcgtagagactcctctgcgattatttagcgaccacctagatgaaaaaaaattaataaaataagtagaataaaatgaaagtagtgcttggtacattattatgatttttatttattgaatgtttttgagaaaattcatttaagagtgagattaatggagaatttaacacaacaaaagacttttgattttttctcaattagttttgctagttgaaccaatccaacaagttaactcacaaaccaatcaataatttcttattttattttatttttatgaagtttggtgcattaatttatagaagcaacgagacatgcatggctatgtcctagcgaacatagagtagtagtttatacaagtataccaaagctaaaccagtctcgtgaactatatatatacgtcaacaccgaaactttggaaatgtataatacttgtatagttagtctctgtgtctgatattaaattgtacataaatttctttatgattacagtttttttttcccccgatttatttgacacggtttgggttatatatatgattagtcacacaccgacttgtaatatactctccaatacacgcttttaaatttggtgcgttccaaacggatgataagaacaccatgtcacactaatcgggtagggacgtccactaaccatattgacagttgtatcaactacaactacaccatatataacggtagatccattgcattcgtgtggaatctatagtgtttatatttgcatatatcatgtcaaatgatattttgctaatgtaggtaggtgacgccatagaacttttgaatatattaatatggaatcaatgcttttaagaagtggatggtgattatcatttatcactctatcatcccacgtttcatacacgctgcgacttatattttgatttacttttcttatgggtttggtccaattccaccgctaaacactatgcacaagtgcaaacaaatatttaattaaattcaacttccgatttaatcggtcattcaaatgagactaatgagtccaccaaactccacaattagatacccataaataaaatagaaaattcgaggttatcaacgtgcgataagatccactttttgggttatataataactaaataaatgaacaaaacaaaaatagatttgactaaaatttggctataaataaatttgagtttcaaagaagccaaacccgtcaacacatcttctttaagcatctctctcccttcaaagaaaatatcacaaaa

SEQ ID NO: 4759 - DNA, 2000 bp, Arabidopsis thaliana
ttttataacaccatctacagatgacgtcagactgcacttaatggtttacacataagatggtaacattttgtactacggtgatacaacataaccaatcaaagccattagtagagtgataatcaccaacttttaacaaacttagctacagatacttttgataatattagtggttgaaatatatgaacatttgaagctctaagtctatgtttcttcggcttatgtggctcacaagtcacacctggttatgagtatcacttttctttaaaaaagattatagattatggcaatgatgaatatctgaaattctgaatgggtatccagtcataatatgacaacagtatgggtataaaagaatatgatggaagaaaatcaatcaacgacaaaaagtcattagctctagtaagtctaggtttttggctataaattttagtttgtatattttttattgttattgatgtacaattctggttgtgaattgaaaaaaagaagtttgattggttatatttagattaacaaatgatttattttttacacactttcgatattatttttattggttataaatatatgaaacatttacataatttagtaaaacgttcaacttgataaaataaattaactaaataaacctcttgtataggcatctgtcttttattctattttttttatatatattaccgaatttgttatttatttctcttctccatcgtttacaatatagttttcataactttagtgtattaatatacatttcaccagctgtaacgtgggccgttgcttaagacatcagctaagtgggcacaaaaggcagctaattcttagaatcgtaagtcatcgtctcacttcatattttggaataagattctaagagataataatattttgcattatcaaaccaatccgaatttgccaaagtattattcaattccgactttctatattttacaaagtgttatcttacttttctttcaattatattacattattcttaacataattacagtttaactttttgttttatttttattaatgaatataaatttcactaaactgaatgagctggttagttacttttcactaactgaattatcctctttattgagatgagcttttaagcattgttttgctacacaatgtgaataaaattttatgatgctattttcaatttgaatatattggtataattttcaattttattttttgaacataattttttatgattatagatattataattttacaattgaatgacaaaaaatattaaataccataaataaaacatcattacatgatctttacaactttatttataataattgtctatcaaactgaaactagatttttgtataagaaaaaataatatctactgtctttttctcactagaattttgattttcattgatgatatataagaaaaatacaattaaggagcctgcgatcaaatgcataatccccgaaactaaccggacagatgacaagatatccttggaaactaaactcaattgaacaaaagcaaacaaacaataacactccaaatgaaaagcaatggtaaaacaaagcagctaaatggggatctaccgtcaacaacgaataaatctaaactataccatataacccaacatcaataattcaaccagtatataaattagccacctaaagaataataatttggattttttcggaaaactccttatggttctatgcttcaagagactaattacgaactatttttttttttttttgttaaagagtttgcatcacaatcactcttatccaaaataactaagaagaaacatattacgtccggccggtaacctttttgaaaaggagaaaaaaaaaaagtatttgttttcgatataatgaattatctttctagttaaaagtaaaaaagattcgcttaaacattacatttacaagttacaaacacaatcgttcactataaataaaggtgtagcccctactaataaatatataactcaaagcataaagaaacatcaatc

SEQ ID NO: 4760 - DNA, 1035 bp, Arabidopsis thaliana
ttgtatatattgttgttgtttgttaaatcattgtgcgtgcatgtaatatcttatcagttatttgttgggtaatcgaattcgtcttgttttgctattagaattatgtaaatattttaaaaactacaacttatatacattgaaatcgtagaaagagccaatgtctaataatttcattgtatagacagctgcgctggtagtccggcggagttcaactttcctaattcttctagcggttttaggcttattatcaataatgttttttttaaagaaatctacaatttccctaataattccttttatgtatatccgtttatagtttttcatattttaatagctatacaaaatttgatttatcttgtcaccaatctgaatttcaaacaatcaagatatttgtcataaggagattttttttttttttttttgtgcacctaaggagattttattttaaatgaaattttcattaagagttttgatttttcggaagaaaaaaaaaagaggaaacaaaaaatacgtttttaagaaaacaaccaagtatttcacatatcctaatttaatatcctatcaaaatcagtcgtcataaagcaaaaaaaaaaaaaaaaaaaaaaaagactagaatagctagaaatctagagtacacactttgatttagtttgaagacaaatgttgaggcttgtttgtccatacgacataaaaagaaggagagactgagatattccgaatttgatttttctttctttattcgtttatccaatactaatttttacggctataaacttttcactatcttttcgacgtacctctagctaaaagatattttctcttaaaattttgggcttatatgaatacaaaagaacatatgagtgcccgccacgatatgtactgtgaaccacttagtgtgttttgtaactattacgaataataagccaatttccttttgttctttcttacatcacatcttaatatatgtaggcacagagaaacacacacattatcggaaccaaagcaaaaaaaataaaccttagaagagagttcctc

SEQ ID NO: 4761 - DNA, 758 bp, Arabidopsis thaliana
catgtgcattacggtctgtgtgaataccaaccagttactgccgaaaactttgggggggtttgcgatatatatccataggtacagtgtgcaatgagaaaccatccaggtttttgtgcttgttgtaaagtgtattatgttttcatcttgtaaaggatattgtcactcgtgtgtcatctctattaccaaactcaggaaagaaacattcacacgaaattgttgtaggctgtggtcctctttttattgattataatttttgaggctagtgttggatatacttgtcttgacagagtccaacgtttgatttatcttcagttagtgtttcatatgagagtttaaacggtctttgaagtttcaaacacacattagattttggtaacattggtaatttatttatgtggcctctatgtttattttgatttttgagacttgacgatagatgtagctatcactatcagtgagccctccaagttgttgttttgtgtatgtgaattatcttcgttttctttatgaagatatgtttctaaacttttcctgagaaggaaggtcactacgatggtcacatacggacaaactaagtagcaagcacaatctgtggacttaaaaagaggtgtttggcaagtaaaaaactgtttacgtcatctgttacgtcttctgttcactttatgttttactctccacgcatcttatcctttataagctcgcacaaatcttaaccaaaaccaaagcaaaacttgagagtttcttactaaggttgaatc

SEQ ID NO: 4762 - DNA, 2000 bp, Arabidopsis thaliana
agggaagaatagcaagtgaaaccacatgatcttacaggaattagaggttatagtaacgcacttagtcggaaactgaaattagctacacaggttaaatctacaaagcgaatctaacactagtgaaatcaggtccaaaagcaagaattctgtgaggcttaccggaaataatacttgtactacaaaaatcagaaatcttcggatcagctttcgctttcacttcttcttcttcttcttcttctcatctcattttcttcatctagatctctctctctttctctctccaggcgtttttcagctctggttcctactttttacgttgtgaagaagaagaattgtttaggtaagcttttaaatgacgatattaccctccagtacagttctcacagatgttctgtttcattattttaattcacttgttgcgtgactttgcctccttgggatcgccttcgctgccaacttaaaaaaaaacacgactttcatgtccgaaagaaaatattcttttatcgaactacaactaaatacagtatgacattttatttgatttctttatttttcaatctgatacttcccatttacccctgatttatatcaagtctgcagttcactttttctttttctatacctgtctgctcaagaactaaaatgattttgtaattttaatacattttattatccggaataacaaagtattaaatcacgaaagatgatttaaaaaaaaaaaaaaagtattaaatactagtaatgataaggaggctgacaagagataagtgacaaagacagggaggtcttggacggtgagctctcggtccactttcgtcaccctttgtttttttctccacgttcgcttttagattcgacttattgcgatcttgcgtgtcaaactttttccaatcatctaaaagttgagtcggagttagagttacgttgttcataacttttatttaaactttgcaagaaaaaagtatatacgatatatggtggcttatcgttatgtatcatttcattcagctttctaaaatttataatttaaaaaataatattataattaagattaaaaacgataaattcaaatttaattgactgagaatgtttttggtgtttggtatgcattacttgtttgacacaacttatatatcatcctttatttgttactcaaacgaagattcacgaaacggacaaataaactatccacctattgggaacaaataggttgtctgacttttaagcatcacaaacggttatatactattttacataaacgtttcgagtgtgttaagattcatttaattgtaaactaaataatcaacagcgtgacttcaaatcaaattgtcttcttataagtttattactaacatatattcttgttcagtttgttgccaatattgaattaattaaaaggattgtgtatattttccttaattgtattgttttttttgtcggttatagaaatgcaaaacaaaaagaaatgaatagaggagtcaacactcaacagccactacctaacaaacacttttaatagttccagctcgtatcgtttttcatgcctccaaagattaattatgattttcaaaatcatttataactatccctccacatgtctttaatagtcaaattgatcttatattaaaaactctatatagtaagaccaagtgaattttaaaattacatcaatgcgatttatatggatgattcaaaagtatttatatttcaaaactgaaacaaggccttgcagcctttcttaatgcttcgtgcagataggcccattaataaaacaataaagcccatacttgtaaaatcaggtaaagacgcaacgcaagcggcacatcagacacatatccattccgaccaaaccatgataaagtatatgccacgtcactattcatcgtcgattagtttttacgaaattgaccaacataccctcgttgtttggttttatctacaacgcagttgctgagtcacacttgttttcttcactcggaaaattcgaaaatcgagatcaa

SEQ ID NO: 4763 - DNA, 1113 bp, Arabidopsis thaliana
attggttgctgtgtttaagtttatttgcagattaatttctctttagagaaaggctcatttataatataatagagagggaaaaggaacaagttctagagagccaatgtagttgttggaatgtgtaatgtaaatctaggtgccctttttttttttttttttcatacctcgatatatgtcacactacgtttctggtcaaataagaacatgttttttctttcttttttgtatgaatttgtttatcagaagtcagaatgattcagttttaagaaatttttagttaacgttttacaacaataacctgtaggagctttttcttaattgaataagtttaagctttctattttgatctgatgatgctaatatgaaagcattctccgaagaaccaaaccacatgagactttttgatttcaatgtccattcgtaactagtaacggaaaagatcagacagaaaaaatgtaccaatcattccatatttgtagttttacatgatatagtaatattctctaggtgtttaagttgtatatttcatgatttttacacattttaaaacctgattaaggcctgtttttaactttttatttcttcaaaccgtaagaaacaatccttgcaagaaacaatccttgcttcttcttctttttttcgtcaagaaacaatccttgctatattttcatttttacagcttcttgtttttaagagagcaaatataataaataaggacggctgaaaagaggtatatgtatcacaaaattaaacaaaagagaatccacctatcgacatagacgtggtatcctttcgatatcgacagaattatgttgaacgcagcaagttggccattaatcaaatctttgacgcgtggaatcattctattgtcaatgaaaacaaatattaaagaacaggtactacctatatacctaatagattcctctaacccgtcaaatgtcaatgtatcgaccgttacaattatgcacgtcttctaattgaaacattctctactttgccaatgtcttatccccaaaactacatataaatatgcatttacgggggcttagaatttcatcacaaaacttgcaagtatcattcacaggagagggaagggagagctcatcatacgaa

SEQ ID NO: 4764 - DNA, 791 bp, Arabidopsis thaliana
cttcaaatatcaccaaaacaaaacaaaaaccaaaaacgttttaaatttccaaacaagaaatcaaaactcaccaacaaaccctaagaatttagaggtacaatttttaatatccaagatatgaaattgaacaaaacccacttcaattaactgacaaagaagctagaaaatgaagcgattcgtacattagaaacgaagaaccctaaatttaacgaaagagacaaaatcaaattgagtttgggttacttaccaatggattaatggcatccgtcgttggccgagaaatcttgatataatcggaagcaagaaatgagaaatcttggtttaatcggaagcaaaaatatactcaacagagaattagggtttattttagaagtggttgaggcgggaacaaatcctgatttctccgatcttagattttcttttgacccgcgtttcgaattcgtcggactcgggagtcacgcgcgaggactcttagatttacttaatgggccacaaattaaaaacccacagttacataaagcccaaaagcccacattacctaaaattaggaaagttgggtaacaagatggaaaagatcaatctggcttatgtctggtcaaaaatcttatctgacaaaaaaaggaaagagatcacctcgaaaagcacaccagatagagccaaattgttatccacttatatatctacacgtcattgacaacgacgtgtccacgtcatcttccttgccgtaaaagcattcacctttataattttcataaattcgttagcgaagagaaaattttcaactcattgaa

SEQ ID NO: 4765 - DNA, 1505 bp, Arabidopsis thaliana
atctgaagagcttctagctttgttttgtcgttttgatacggtccagttttgttttccttgttcctaaatgggctttaatgggtatttgttaaaatttagtgggccttagagtaagcttatttgtgcttgctttctttttgcttcataaaagagtgttttgtttgttttcattctcctaataaatcagtgcttacatgatatgtttacatatacacttaggctagaaataaaactttacaaacccaaggctttgaagtttgaatataaccatagatatgtccattaaaccccactaaaatgaagtaggcttgaatccatcatatataaatgttaaattaataggggtgggaaaaaaaacgaaaaccgaaaaaccgaaccgtaccaaaccaaaacaaatggtttggtttggttatggttttgtataaaaacccatttgattgtaatttttatttaagttttggtttaggtttggtttgattaaaaaccgtaaaaccgaacgttttttttgtttttgatttaaattaaaaataattgtatatatatatatataatgttcatttgataacatgatatctatcaaactatcgaaaaacaaaaccctaactgtaacctaaactaaaattctatataaattacatgccgtcatttaggatttgagtttacaaattagattttgattttatttatgcatcacacttataattttttttggtaaaaacatgaaaaaaccggaaccaaaccggaaccgatccgaaccaaaatacatatggtttttaaatggttttaattttttaaaaccaaaaactgtaaaactgttaaaaccgaaccgtaaccaaaccgaattttatatggtttttatatggttttacttttcttaaaatcgaaaaaccgtaaaacctaaaaccgaaacgaaaccaaaccgaaaaactgaacacccagcccttaaatataatgaaaatcgaataaatttgtttgaaagaatcgaacaaaattgacaataaaatctaattaggactattttcgtctaattttgacttagttgaaacagaatattagcaaaaatactaaaacaccacaacgcgtaataatacccacacacgatatcattaaatttgaccaataagaatctagctcttggcgaccacgcaagtatcttccatcttgctctccaagaaaaatctacaccggctttaaatttacataaacaccctcagtcaaagaaaagtcgtaaacatagtctctctcatgaccacaagggtaacacagtcatcctaaatataaaccacacaagaaaactgttatactttatacacgtgtcatagtctcattacatctacgtgaagagtttcgatcatcaaccgttcgttttcttactatataaaccttgctcgagacctgcgtgtgaagcgtataaagacgacaaagtaaaccaaaaaaaaaaagagttctcctacaattttcctaaattcttggatttgagatttcactttttccgatttgaaaca

SEQ ID NO: 4766 - DNA, 2000 bp, Arabidopsis thaliana
gattcagatgtaaatggacgtaaacttttgttgatgaattgaagaatcttggcctttagctaagaacctaaccttctagaagagggccatcatcatgcatgaggtgagtgattttgtaccaatagattaaacaaattgaaattcaactactctctctctctctctctctctttttcggttttttcatctttttcaataaaccattattctttttcgtttcttctcacattttccacctaacttaccaaatttcacaattaagttcaactttttttgtttagcatacatggacagtacacagtagatactatagtttaattattctctcctatatactgttatgtgttctattcttcaactattctcctgacatacgaattactacatacgtatatgattagtgttgtcgatcgtattctaaaaatatagatacgattagtgctataataatattccgtccagttagagttcaacattattaaaaaaatatctcttaataagtcttgatttttcaagtctctaatatgaaagaaatagaagttggttagagaaaaccattctaagtcaaggttctagaaggcacattctttaattcaaatagtttatcatatatgtatatttctaatttatatgtatgtgtcatggtggttcttgttgtattgtttttatactgaaatattaaagaaacatgagcatcatcacaaatattttaaacatgaagtgcttgtcatttggtgagagtaatttgaaaaccatatataagttacaagttatcctgcccacacatataattagttatttgataatgctttgtttaattagcaagtgattgtattagggttaagttctagatatattattgattaaaaaaacaataactaatccagtgcagtctatatattagagaaaagactgttgaccagtacaacaaaaacctcataggctatatagttgacctgcacttgtccaaaaaacactcattaactttaccacctacctccactacttcattatatcttctcttcgttattgctaccaaattattcaagtttccccttcctttgttagacccaaatttttacttgtgacctataatatctggcgataaaagccattcacaaactttttgttttactgaattttaggttttctacattaattttcacccgcctaagttttactacaaacttaattcatacgataggtaagagactccaaaaaaataaaaataaattactgtttgtactaaatcggtcgaagttaaaagacgatttgtcaataaatgtacacagtcgaatactcgaattgtcatgtattgattaatttcttgacagagttggtttatattttgtactaaataaaacttgttgcaaagtaaaaaaagaaagaaaaaaaattaaagaagtagctaaataattttggtttatgtatatacgaacacgagaaatttctttgattacatatatatatatatatatatatttaagtgagaaatattaaatttgttgtcatgattattaaaaaaatgtcatagctttatcaaaagactatgatgccatatatgtcaagcttctcacttattgtaccaaaacgaaaggccaccatacactactcattcaaatccatcccaccaactcacatctagaagcaattataagttcaactctctttctctctccttttctatcatctagaagcatttgtgtatatatatatatgtgtgtatattcctctctagctttaagtcaaaaccctatataaactatacaccaaagctttgaaccttcaaccaaacccaaaatccaagtgccccaccaaatgcttcaatcctcttccactacacaaaaaaacaacttaatccctttatacccttttagccaaaaccctcgctaaaagccaatccctcaatataaaataacaagtagaattgatctgcctatatataagattttgagacgaaataagatctaaaccacaagaaagaaagtaaacataaaagt

SEQ ID NO: 4767 - DNA, 2000 bp, Arabidopsis thaliana
tttcaggtttaaaaaacctgttgaagcattagagtgttgatgaatatgagtttccctaaagtagatagtatcttcagtctgaagtatatatgcatgtgttgtttctgatcatagtgtgcatcaaatgggatggttctgaagatcttttgacaaactctttgtctatcaattgatgtttaaggttcaacagcgattcagtttcataaaaggtgatgtttttgcttttgcttttgttagcagatggtaccaaatcaaaaagcttaggatcatatcgagtgccccttatctgatagaggactcaaggaagcagatacttaacctcattaagcatcatgctcaatcttagctccttattgtgctactaaagttccagtctattggtatcctcttccaatcttattatttgtgttgtttttttgtgtgtcctgacgtttcacagtgtccattcttcatcatgtcattctccattcttcaacacatcacaattatattttagctaaatagataaaatttattcatatgatttattctaagagatattcgacatttttcaatataaattttagaaaccaaaaaattgtgtaactcgaaagggaaagttcatatattctttgtgaaccaaatcgaattctctaactgaatagtattttgtgttttcatgattttgaagagccaaatctacttgactactggttgaaaattgaaagaaaccctaataagggacaatgataacgaaagattgggtcctcaaacaatggacaccactattctactgccatttaaaaaaaaaagtttaatatttttgaattttattgttgttgttttctcatttcaaaacatccaaaattccaactaagataagataacttatttgcagtaagaaaaacggataattttatttatttgaatccatccatcaacataaaggtgtgcacaaaggacaatattaggcaaatgacaatgtcacgtaatctacgttgcccaattgaataatttgattatcataaaagttacacaagtttcattattgagtattgagtactgaatagagatatcttcaaccataatgtagctttcacaatttccatacgcgaaaaaaagatatacacaaatggagtgtgtagagtaaactaaactcactctattatgactaacagtcaataacacgtacgtagttatcaaattattaatgagtaaaaaagttccaagttaaattatgtataaattaatcatgtattagcattagattattaaagtgtgaaaaaatgattagattcagacaaccttgaaaataaggagttaaagtcaaagggcgactgcttcacgtaactttagacttacgtcattactaacgtcacctttctttgaaaacctcctccttttgaaaacctcctccttttggcaactttaataatagatccaattttcttggtttttccccccattatttggaaattataaccattttactacaagtgccttctaaattctacaacccaacaaaaaaaaaaaaattatattacatatcatacaaaatagctagataataagtagttgatgttattgttatgaaaaagttggtggcactaaaaacatgtgatggctaatgacccttagatatgtgtagataagcagactaatcatgcaaaaataaatacaaaattgtaaacatcgtaattgtctggacaataaatcataaaattaaaaacataaaaccatttccaaaataaaattgtgtatggaaaaaaatatatattaatctcacttactatataattcattacctccttaatctgcagaaaaatgtgtataattaaagaataaaatatttagagagcgctaattaaactgtaattactttttgagatttttttgggtcagagtcaaaggtcgccgccatctctctctgtgtatataagctatgttcatcttcttcactcaacaaccattctctcttctcttctttatctcaaactctttcttcttccaaatcataaacc

SEQ ID NO: 4768 - DNA, 2000 bp, Arabidopsis thaliana
gtcttttgtgtgtgagttaatttctaaatttgtaacaaggagaagagaaacctctattagtgcttgtaatactttttgcttgatagtgaaaagttgtgggagacagttcccacccgagacgtaccggttagaggccaggaggcaggaactcggtgatcaaactcttgtgtcaatttctagcttaagcaatctaacgttccacacatatagaaaactcaacaacaattatttagatatgaatgatcagatttgatgtaccaccatcgatatgtgctctctgcgaaaactctttatatatactgaaagaaaacatacacccacattggtagttttttttaatggattttactagcagaggataataaatttatcgcatatattacttacatttgtagtttcaaatacgaaaaaacttgaccattagtagtgtgaagtgtgtaattgatacttttgagttcaggacgaaaaaatgttcacgtcattcgtgaggaaataaggcatttagactcaaaagtccaaacatgtgagaaggtcctcgaaagggcgaacaataaaaagccccgaagcccataacacgagtgccttcttatccccatgagtcttcgagtggacaaagagagagaacaactttgggaaatttatagtagtttgtgaagacttcatataaaaattgtatttatgagattattgtgttttaagaggagagacgacgagggtcatcattcatttaattacttttaacattataattaagttctgatttatccggtcgtttatgtaatttattgattatatacttaggttatttagccggccacaaggccaagcaagcaaaacataagcttgcggccgctaatcatattattatttagttttggccgaatttgcataaaaatgtagtctaatggttaaagtttcagtatttgagttacaagttccttagttcaaactttgacaatgtgttaaactaatttttttttaaacgacagaatcactaaataaataaatattatgtggcccattttgtttctcttattgtaaccccgtgaaacccggggacgactaggtaacaaatactctttgggttttcttataaatcaaatgcatatctttgataaactaaaccatgaaagaaggagtttttttaactgatgaattgatgattattgaagttgatataagttagattcaagttttgatgtactgtatttggaacagaaatgttataatatcttactaaagcccagttcggaacaaggccttacccttatttaaagccccagtagatctgttttgaattgtcgctatgagtgaatgaggatgggtaggtcgaccctcagaattcttaattggcacatgttgaatgtgagcccaaagcagccaccaataaagtgaatcaactccgtcattttcaatgctttttcatgcaagaggaaacattaaaatatcgtcgttattagtattaattatgtttttgacctgtaaagaatggacaaaacttatactaaacaaattatttcgccgtcaaaaaggaaacaaaagttcagatataaattcctggtagcttcaggtcaagataaagtcaggtcaaaggtgatgagctctataatgagtcctccaaatgtgatttaagtttaagaaatgaacacacttttcttaagccggcattagttttatgttattaccccacaaatgatgatgatgatgtcgcatggtccttcacgtgattacaatattaatttgccaagttgatatcgtcatgactcatgagcaaagtgctggtcgaacatcgacgtattcttggataatgttcgatttttgaactggtcctaattctaatatcaatattcttacgaaactaatcacattggtctataaaagcccactcacacttcatcttccacttcaaaattcgaactttcgaagattctcattctctccactacagcaacaaattcacattcctctctgttttttttgttttcgattctccttcttca

SEQ ID NO: 4769 - DNA, 1660 bp, Arabidopsis thaliana
tgaactcagaagagcaatggaagcttcatcaaaatcaagtctcttcaatcttacaagagacgatatactatacgaagacgaatacctaatggctgtgaataaaccaaaaggtgtttattgtgaagctgttcttcgctctgctcctcaaattgttcttggtgagtgaatctaaaataactaatttccttcgtcaattctcaatgttactgaatctaaaatctaattcgattttcagattcttcgagtgagtatcatttagcgaatagattagatcgtgatactagtggtgtaatgattattactaagtcacataaagtcgctgctaagcttgttaaggcattcacagaacataagattcgtaaatcatacattgctctttgtattggttcatctccaaattggaggagggtcacggttagttcaggtcatggacggtcgaaacacggagcttggcgggtttacgctgcgttagacgttggtagagttttacctggtggatcttttgttagagatatggagacaacgtttgaagttgtatctgtaaacagtgtgaaaaacgaatcttgtgaactggaagatgtgaatcatgtgattgttgctgagggggagagggaattgagttgtggtggagatgatgatgatgttgttgttgtggttagggcgtttccgcgaagtgggaggacgcatcagattaggttacattgtcagtatcttgggattcctattagaggagatgttaagtatcatggagtgtatgagtggaatggaagaacatttgaggggcatgagcttcacgctgagtgtttatcgttagatcatccggttacgggtgattctattgttattcgagctcctcttccgtattgggcagccggagattgaaaatgtaacggttaagggatagagttgaatggttagtgtgaagattttgacctttgtttaacaatttgttttccagaatctcatttcttcagtgtcaaagatggaagatttgtttccgaaaatgcgcggggaatttgtgtagctcaatacaaaaacattggcaagaaggaagtacattgaatacaatcctctgtttgcttttgttttctcgtcctttctttttgtaaactacacaatatgatagtccatttttgcgctgaactctcgatagcacaatgtgtttctcatacgaagtctgcagcaacaacttgtgctaggcttctatgatttttcttttgtttcattgtcaccagttttatgtttgttgtgacaaaggtcagtgaagaataaacaaaccaatggaaatcagttaagcccttcaatagtcttaagaaaaactatcaagactctcaataaataaataaataaaaggattttgtagataaaaaaaaaaaagttcgaatctgacggctactattacccacgcccactttactctctcacgtgtaaactcatgcgctcattcgactccaaattcgtggttttgtccagtgaccatcagccacgtcattatcatgacacgcaaatctggcgtgtatttaactaattggttaacgtggatataaatatgacagatcattaacccacgtcagctaccacttcacttgcaactactctcggtatatattttcaaaaactcttttgttttcgtgtgaagctccgatctgagtttttagca

SEQ ID NO: 4770 - DNA, 1467 bp, Arabidopsis thaliana
aaatttaatagcaaagatttgttttgctttctattgattttatcctgcgatgtgaggtataaatatgaaatttgttgattaagttccgtgaaataaaatgtgagatttttaataacatacgtcgtctatagttgtcaattgtgcctgtcgaagtggataactcttttcttggcgaacccaaaacaacaaatttgtgatgtgaacaaaatattttgttaacttaattactaaagtacgtatacaattgatgagatgcttatttgttttctgttttaattgcaagttccattcacgacattttaactctagctacgtgaaaaatggatcgaaggatcggtagccgatccgaaaaactagccatcacatgcgattactagacatagattagtagtattatttaattctgaccagcagtatagatagtattcataataataaagtgttcagataatcgttttactgtaacacgctttaaaataaacatgataataactacccagttgccattaaattataattcatcgtccttagcccatgtgataatgggcttagtgaaacatattttaaaataatgggcctgagcaatgtctttaaaatttgtcaaacacttgaggacggaaaacaaaaacataactaaatgcctaaaatgggcctctcgaaaaagataatgtgtttaatgaaccatatttgaaagtaatgggcctaagcaaataggcacgaacatactagaaggtagtttgccaatgcatatctgaccgatttctcatttctaaaaccctaagcttcgccggcagctccgatcgtgatctttcataaatcctaccatcgccgtcgattaagagctgagctcaggtttatctatctgctttttcctcccagttttcactgtgtttcgttgtatgctctgtttggttgtcgatagtcacacagtgcctgatcgtcggtcaatttgctaatccttgtgtgatttagagttggaatgatcatttggtgaaatctcgtggatcttttcttgttgaaagcttgttgacttgctcgtcatatatattcgacgatctatgggtactgtatctagttgataatgttcaaaggcttgatcgattttagccttgggatctgctaccgatgctttcaatttctgacgcttttctatgcgatcttttcgaattcgtttttctctccagtttttgccatgtcaattgattctcttagtaacactacttctttgtttgctctcttggattttttgtttcttctgaaatggaggcttgtgcattgattgttctatgtgtgtgatttcttatgcggtgttaagtcctttggatcttcgtataatgatgtttttaatctgctgacaaacgaatttatccctgcggcgttttagtttgctacatataaagttcttagctgtgaactgtttctcctgggtatctcattgcggtttgaattctgttttgctatcaggaa

SEQ ID NO: 4771 - DNA, 920 bp, Arabidopsis thaliana
aagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 4772 - DNA, 1168 bp, Arabidopsis thaliana
ttccatagatataagcagatgcatttacatttgtcctctctactctctagtattgaaatgcacccatatatctttaacaggtctgggaaggaaaaaccaatgatgagaaaccaggaactgttgattctaccatgtaaaatgcgtataaagatccctgcatacggtgggaagatgaagaagtagtgaaagataaaatcagggttgggtttgttttcgttttagcttagacagattttcatttttctttggtttctggttcggacatgactctgttgagtcttttcttaatttcttctagattttgctttcaatctgaaaatttagtatcttctttccttctccatttctcctctgtttccaagttttcaaaacctaaaaggctgattggacaaggataacacatccaattaaaatgttatgtttttgttaatactctataaacctttgtagttagaccattaatttttgtgtgaaactcgcataaaatgagttagttgcaacttgcaagagaaagatatcgattcgtgtcggatccacagtgacaggagtatcggagcttgagtcacggagctaggagggtatggacggaaactaggaaatcgttgaatctatatgcataatttcttaaaatatgaacaatgagtttatatatgttaacaaccatattaatttatacaggttttactacatcatttaaagtatgagggtaaatgagtatattttagacaattacaatttttgtaagaatcatctgcatttaaattcatctgattttattattattttggatgagtatgagtttggcaaaccatatggctaaaacatctagatgatgtctttgcatttcaatatggatttcttttaggctttagccttttgggccctaatgtaacaccaagtctgcgacaccatccaaaaaattaccgcgaaaaaaaaaaaaacttgcgagagagatattgattcgtgtcggatttgacgtggcaggagtatctatcatctatctcgtaattacgtgattaacttagaatctgtttctttcttcacccaccaaaagtagcaaacctttgccacctaaaaatcttaccagttgggtgaaagttgccaaaatagagcttgcttttgtcgcaatcctatatttttcagattgattgttggtgggtttgtgtaa

SEQ ID NO: 4773 - DNA, 2000 bp, Arabidopsis thaliana
tgatcgcttcactaaacaaacacgagtcgcttccggtttgtacttaaccggcttgttataacacaaccacggttattttatgggccagtttttctgtttaaaggttcgatttaataggcccaaatatacttattaaggcctttgatataaaatgtgttcatatctttatcttcttttaacgttgtataactttattcaaagtgcaatgtgatcctttaccattttcgaaaattgaaatccacttcaatgtagacatctccaactccttgtcaatcaatttccggattgaagattgggtactctctctagatttagttcccacctgaaaatatgggaccggatgtaatagtaacagatttttgtattggtcaacaatgacttatagatttcgtttttttcatggaaaggacttagaaattggttagggtttaatttgttgaccaatacgaaaatatggtcccaaagaagtgttgccatactaaatgacgaaaaccggctgccgaatatttctataggtaggacatagaacttacatcaatttgcgaccacatatattggaggtagcattttaatcgtctctagacttaaagggctatagcagatagaggagacggtttactcactcgtttgctatttgcagatatttacgaattttggcacatggatccaagaaaacaattctgcctgttgtgtgtggatagattttatgcagaaaaaaagtactagtccatcacatttactttaaaaattaaatcaacggcctagtatttttgttcgattataacaaaactattataaaaaaaaaaatgtacttatatttaacactattgattaattaataaatgaatcttccgactgttttctttgtagggcgtgatgtaatcacgggacggtgagtcggtgatatcattcgtgtgcttcactctctaaacatatagcgaagtaaattgacaaaaaaaaaaaaaacaaatagttaaccgtcgacaattcaataatggatagagtttgtgattaaatcatctataacatatatatatatatatatatatattaattaaatgtttgtctcactttgcatgtgatacgaaatgaagaaactacaaaaaagtgaagttcgaggtggaataagccttttgctttctcacgccacactaaaacttgcgtatgtgtttcgattctgcgccggtcctgttgattatagaacatgtaatttaataggagaaagtaactgttagtatagtattaaaaacgaatgtatataattttactattataggtatgatcgacttttgtactataaatttcaataacattccttcaatgaaaaaaaaaagaaagagttatattgtaatagactatagttttgtgagagagtttcaagtaacgtttgcaattggacgaacttttaaagaatattaactgcaaaaacactacttgggtgtagaaaagtgttatttatgaaccggcccacagagtcggagtttggtcggttccacaaatttcaaatttacgttgtgatctacatacaataaattatcacatcttataaagtcaaatgaaactacctcaactatactagaaaatattgaatactaaattataaaatacagaattagaaacttatcaggggtgttaaaatcaatttacccagtagactttttattattgttgaactacgtttaaacaacatatagatatttcgaagtcaatgcagtcaaatatttcatacaaaacactttcgacgaacacaacttgtatctttttttctctttggtgtcaacaagacttgtatatatatcaacatcaatgaaaatacgcaaagatatatatgttcacgtgacaatttattacattaaattgtatatagtctctctatggttctatataatctcatactttctacctcatctctatagtaatcccataatcaacaagacactctaatagtaatatctcaacctccgtctcgttttcccattaacctacccgtttgttagatt

SEQ ID NO: 4774 - DNA, 2000 bp, Arabidopsis thaliana
attccaccaagtgttgttagctcaattggcgaaattcgagtgacgcttgagacgaaactaatattacatgctgtggtttcagacctaggggattacgggcttcagtccaaaacctcctgatatttaaaaaaaaaaaaaaaaaacgtatgattccgtttaaacaaatatctagtcagtatttcgttttactgttttgagatttttaacttttgaaacataaattaaaattctgattaaaagttgatttataacgagcaattaaagtgtttcattttagtattttataaaaaattctttcgaatccttcaccctaaaatgttatataacgaccaacgaccaaattttttgttcgactaccaaacgaacaaaaaatgtgttgcgcgcaataacttttgatgatcgcaatcgttggtatcagtctttagcaactgcaaacatgaacatagacttcacattttaggtatttcaccattttctatagtagtagtgtagcaatgtactgtgaattttaattttggtcttactcttagatgatagatttgagttggccgatatgaacattggcgacaatttgttattttcgtctgcgaacctgttttaaaaacaaaacagcttaatacagcccaatgggcctccttactcgaatcaataataagcgatgagtgaatgacacatgttagcaccggagagtaacgtacaaatgataaatgccacgtaagccaggttgcatcgatttgataacacaaacaaagccacacgacacaagagaaatagataagtatggacagtcagcttttgtctttttccagcctttgtttacgtggaatctcggtttctaggacccactacactccttaaataagaggtgcataattttatatttaacaaatacaattagcattagattagtccaaatatccggagtgattttttttggtttttagaatatttatttttttattgtaaattataaaaaatgttatatataatttttttatagataatttttttaattttattagatttatgatatacaatgtattctttttttatgttataaatatttttaataaaatttgtttttaataaaattttggtgaacgattataattatattttgttgtaaattttttatacatttatttttattaatctgtaaatttgtaataaattataatatttgaaattcgaattttaaattttttggtataaaattattaataaacttttaatcaattaatagatcaaaaaaatttatgtccaaattaattaattaaaatttttttaacctacactattgtttaatgttatcacaaattataaatttttaaattaattattttgtttggtcggcaaattaagatattattatcaaaaacatttttttttttttcgcaacacattagttactaaatgaactattaagttcacttatcttatccaatttgtgtctaccctacataaaccttgtacttatccctaaatcactttagataaattgttgaaaatttaatttataaattttgtatttaccaaattaggaaaacaaatatctgaaaatatttatttttaatatcttaacaactcgaagaactgagaaacgcgacaaaaccaatcgtcctcttccgatagccacaaaacaaaaatcagacaagaagaaagaagaacgtttcttctaacagatagagattacaatcaaattgactcttaatttctcaattccgtatctctcatttcatcttcttcttcttctcctttacttaaggatctctggtttctctttctctcctctgtcttatcttctccaaagttacgctttttttcaatgaaaacattttcttgattcctgatttcaaatttcacaatctggatttcgtgtttcgaattcactttgaagaaaaagtttctcaatttcgcctgaaaacccacatgggattggaactaaacactagactgacaagaagaagaagagtaatcatcatcgagtgtttattacgatt

SEQ ID NO: 4775 - DNA, 2000 bp, Arabidopsis thaliana
atatagaccttaagacaaggagaaaaaaccctaaaggcagagaactgatgagaaatcgattatctattcatgtggttgagggattagatctcaagcaagtcacaactaatggtactagatatatgatgatatgacaaaagaaaacccttacatggctcttgatgtttcacactcagatttaggagctgtctgaaaaccctagctagctctccttttgaaatcttctcaacccaatagaaactataagtggagactgttacttatagaataaggtgaattaagtaggtggatgttgcaactagcaactagcaagtggtggttcaaagaagggacaaacaaaaagagatgacgatgataatgatgaatgattaatgataatgatggtggtgatgttgggtcattgtcttcatgggattcagggaaagctaactgtttcttcatatctcaccatatcttccataaatgagagagaaagatgagagagagagagagagagagagtacgagagacagagagcgagatggtgacttgtgtaatcttgtgttgtgtttcaggattgttttagggggatgattagaattgaattatgatgggatagagccatcaagaggttcatcagccagctttttaaggttctttcgttttctttagggatcacatttaatgagaggtggaagagcttgagaatttagataatgtttttatctaattaagtcgtctttttatttatacatttttatttcttattttttaagcattaacgagtggacaggagatacatagtagtagctagaaatcatataattggagactgaggattattagtgtataatataatcggtcccgaaaaaatatgcaccgttgtctttatgtatgcaagaatctcacaagctcgtgaacacaaatcccatctaagcgagagagataatatgaacatcgcaagtactaattactgaaaatttcgtgaaggattcaaaaagtatatggagtcatttattttgacttctaaatttgttctataatgcaagttgtatcatcaatagttgttaatttcttttagatttgaagatccttttactaatgctcgaatacacatcatatcaaattatcaatgatcctttttacagtgaatcttagtaagctattcacaagttatgccataaaaaaaaaacaatgtaacatttcttttagatttagagattaatttacaataaaatttacattgttttttgtttgttttcatattaatataattaagatttggtctatgcatggtttcatacttatggtctatttctctatttatgcttgttatttttgagcatggaccatgcttatattctatattgttccaattttattaaattggtagaaaacaaactttaggctgctacctttgattctatgcatctctacatgaaatcttcttttaaactattttaatcaattcaatctttattatcagattttttttaaaaaatgtatattaaattacatatatagtaattgctaattaagtaaattttaaaaaacgtttagagacagaattataacatatgacaatcttacccctgcctacctgtcatctgcgaaccgaccaaagtagtgagtgggcatggagttttgaactgagacacttgtgggtcctttgtgttgtgctttgttccttccttcaagaaagtaagacgtaaaacccgatcaataattcggtatccaattaaacccgacccggacgaatcaacctgacccgacccgacccgatatttcttcaattcgatcgatcaccattgatccccaatcgctgctacgaacagcaagcttcggcgaaaatgggattcattacgactctttaactcatcgatcccaatttgaaaactcgcatttccattgattcctttgatcagttctcaagtcgaaggtaattttgaatcaggcgcgatactccaagttaggatcttcggttcgagcttttgtgtgatcgatctaaaaggctatagaat

SEQ ID NO: 4776 - DNA, 1573 bp, Arabidopsis thaliana
gcccatatactgtgaatatagttgctctctgtacaactataattcgtctgtgagtttcctcgagtcttttcttgtttttaatcttcttgtttatgattttttcctttgaccgtaacttgtcatctttctgtacacccaacaacaaaaatccatgggggatattgtatagccccaaaaaccgaaatagagtttctttttataagatatatattgaatgtttttattataatagcttatagcgtagagatgattcactgatgttagtttcattcctatggaataacaaaatgcttttgatggtatcttcatgaacatgtacgttcacaactatctttgtagctctataactatttggtaactccggtttaagcaaagttctacactttaataatatcgacttcgttaatatatacaaatgaaaatagtcttatagatgcgagagcaaatgtttgagggtaggttaaaggaatcttgagatatggataaacgacactaagttgtgtcgtagcgagacagatccaaactacgacaagtagtaaacggagataataatatccaaaccataagaatccatgaaagcaagtagacaactgcgactttgcctcaccagtcaccatactaataattggagaggtggatctcttaggaatatttacttttataaaagatcagaggctagtcagaactcagggactaaattttattttcagtagtgacatctttaaaagacaacagagatttataaaactccacgtgtacagaagtgaaacagtctgacatgatgcctgatgctaactaactatgtaagataagacatatcttacatagttagttaccatgtaatagtaagtgataacccaaaaatgcaaaaaaaaacatccaactagaacatgtgatatgtcagtatgtgtatgagatcatgtgcacaataatattatcggtatttgtatgtctagttgtctacactctacagctcttactggaaatagattttgaggaacaagaaatagttgaatgagtcattgctatcttctagattttttttttttctgtcataatatcttctagaattttattacttgggaaagcgatatatgatatattctttttccaaaatttactaattaaaaaaaaaaaaaaaaactaagcactctgtatttattgccatattgaaaatgctctttccaccaatattccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccacc

SEQ ID NO: 4777 - DNA, 2000 bp, Arabidopsis thaliana
tgacaaaaactagttggctttcttctttttgttcaatcttttatcctcctctacacattgtctcatattttattgcaatggtaacctcaactctttttacagttaaacctccataaattaatactcgataaattagtaacctctataaattaataaattcaccagatcccaagttaggaccaatgtaaaaagtgtaacacatcgataaattaataagataataacttttttgaaagtcctatgtaaatatatagtctcatcaatatcataaattaataattgcataaatgtatcaactatatatatacattatatgtaagaaatgtttttgatttttttttacttaaatttgtagttattcttatttgaaatttagttctaatgtgttactgtatcaaaaaaaatttggtattgttttctagacatgatataattttgtacttgtaattgattttagaaagatattttctataatgaaaaaaatcttataaaactttttaaaaagttaccaaattaggaaaatttctctataattaaaaaatattaatttatcgataaattaaaacctttttaaattaataaaattttgcagtcccaacattattaatttataaaggttttactgtacttcattttctaacctcagtatgttaaaagtcatgtatgtgtactaagaatcaaacctggcacgcaaacttttgctaattttgtcacatacagttaacatttagcattgtgcgagtagctccaccacattattatcaatcgtttggttcttcaacatgtcttatatatggatcaataatagtttaatatcatatcagtaatctttgttctcttgtcttgcatgtagaacatgtacatattgcttcgtcggcagcgaatgaagcctaaaattaaaatttggttttgtccattgatgatatgatggctcgttccacatgagagaatggttgagaaaactgaaaataatgaagaggatgagaaattataatgatcagacaagtgaagtgtttcattttatagcttagtgtagaaaacgattgcttgtgattgtgaatatatagttttagatgagttgtttttatagtaactttgagggaacaataaactatgatatagttatcatttttattttaaaacaagtaaattcatatgaatttctgatatattcatattttcactatgaatttaaacactataatcttatttcatattttagcatatgatattttgcatgatgctatcttagcctcgactatctttacttcatcttctaaactatatatttatcaaatcttacgtatgcattgcatcacttgtttttacattttgtgtaaagaaaaagttgcattaattagtttttagcggtttagtacaatatggttaatttgataaccacatacttgatacctgttgtatctagagttgtatataacaaaattagaattatattctattggctaagccaatttctctccaccaatcagtttacatcggttatttggaacattattatcgataagcaatgtcattatccaaaattttggaatgttatcgtatgaagaagagtgtagaagtatcttgatcacatatgaatggcttacctcaatcctcaaaaaaaaaaaaaaaaacaatgattttccaaagcatatgtggtaataaataatgttataatcttcacttgaaaaaaaaaacaaatccattggcacagattagccatttgacgacaacctcataaacatattccacgtggaccaatcaaaatagaatcctcctaatcatcttcctcgtggcaacttggccaatccgcatcgtgtggcgatcagagagttaagccttgaagacgaagagataacgaattggttgttgatcactcgctttataaatctctcagtttcttgctcacaccaacatctctctaagcttcttcttctaccaatctaattcctctcttcagcttcttgtgttgtgacgcatactcgtcgcagtcttgagat

SEQ ID NO: 4778 - DNA, 1560 bp, Arabidopsis thaliana
tcaattatgcttaataatttacataattagaatgtgattagaagttatcatcaatcacttttgatatagtatttgctgaagtgaaattttttgtaatgaacagttggcaaggcaggcggggcctaaggagacagcacgtaggcccaagtaagagagaaagagagagagacagagataaatgaggaatcgtcgtcgaattttgtagcaaaactatataataaatagttcctctttatttttatatatttcgatgtacgttataaagaaggttttggacttttatattatgtccgttaataaacggtccaaatgtctctatgtttttccccttatatcgccaaattttcccttgggagttttatagctacgattacctcgtaacatatggcttcctctaataacggaatacagaaaagagtggaccaaaaaaatgcattttttcgattctatgatgaatgcattaccttgtttacaaaaggaaaaaaaaaagaaactaagctttacattattcggtttgtttccaggaaccgtgtccaaatcctaaatattcttacctatttttatatcattatgttaatatttgtctctactagtactgattaataaatatttaaaaaagaaaaaaaaaaccaaaatattcttaggtaaaagtctaaaataacattatcattatgttactatttgtctctactaaaactaattattaaaaaaaaaagaatgccatggcttagatgcaaactattcttagctaaaagtctaaaataataacattatcataaacaattaatattacacttttccatctaatttctcttacatgccctatttttcaaacgatgtcgtttaagaatatcacatagaccttctatttcatgaaaaaactaactcaccaatgcaaataaataaatcaaatgtttgtttgtggataaagtaaaacgttttctttcaatggcccagcatttactaaaatttatttcaagttcttccacgtaaagtctacactacatacactcatacaggcagtgtaacgctgattcgtagagctggagagtatcacaacaataaatttctcttccgaaagaaaacagcctaatattagggagatatttacatactctataagatgttctttaatctcttatatatattacatatgaaagaattaattgtttaattattatccaaagcgacgtgaaaccactctcatttattagccctagctatatctcacaacctccatcttccttactttaaaaacacagaccagatcctatttatagcatccatgtgcgccattgaaaggtaaatttatttaataaagtttacctataatatcaaattatgcaaaacacaggctggttcagttttttccacgaatcaaaaatggttggagaaatattgaataagagagagagagagagagagagagatagagtttcagagttgacacaacattgaagtaaactaaactcctaacctctttatctatgtgtatatataaaactcaaaagtacatataatcttcaccattcacacatagtcacataccaaagcaaaaac

SEQ ID NO: 4779 - DNA, 1657 bp, Arabidopsis thaliana
gtgaatctcaaactatttatcgatcagaagatgtaataaaagtggcgatgacctaattgcccaattctcataaactctgtttttctttttgtgtttactctgtttttctgctgccgagtgtttgatttgaatgtaatcttcgataatgagtcttgatataataaaatatttcttatcttaaagtttaactaccaattaatgttgatctcattcttcaaagttgactatcattctcctaagtcttgaacgttgacttccaaattaggtcgctctgctactcatcaatcactaatcttcttcctttccctaatcgattccaaaccttctgtggtgatggcaagcttcaaagtcaacaatgttattcatatttgtttgagcgtaactgtcaccaaaaaaggttcctagatcaaaaaagttgaaagttaattagtttccgaaataaaacagaggaacaaaaggaagcgtgtttaagataaaattagggttttcttaggaaagcatataaataaattgcatagctgtcgcaaaacctctgtttactcgagtgcgaagaaacgacggaaatggttattaccaggagacggagacccttttcaattctcgccggaattaggattctcatttcctaggtagattacttgtattcacggaatgtaagtcttaactagggtttccatttaactggtcttttctgctcgaacgatcgtcttttaatctctaaactctttactgaagtagacctattttgaactatttttgtttactaatttagcgattagtcatcgacgacctagtaaacttgttataacgagggtatattattacgtaacgatcagttgcttatatttgttatatcttattagggtttttagcctcttgaccttactcatgcaactattgatctgataaacatttttgagtttgatttcgggaaaattttgatatgtctagtcttgctcagagtctcgagctatatctgaatacatctcgtctgtccatagatcaaaaggctcataacttgtgaattacgaaagctacaaaacaatgggaacacaaacattgtgaatggatattgaaacttatgagttcgatccactcgcatcaatacttacatgggtataatccattaaatctaaagacggactataaggttgtgaatgcaagcaaggcgaagctagagaaggttctagatagatttattacgaagaacgattcaaaaagaatagcttcttgactaataataacttcacattgcctcatctccttgattcaatgatccaatttgaacatccaacgatccatatgttttcaacaacgtcggtcaactttgactagtatacattaaaagactattcttgttgtcttatccagccatggttgatattttctccgattatattgttttataagttatatgaacagtatatgaaaatcttgaaccaatagaaacgacgaatcatacgttactcagcttgactatgaaataacaaagagtattcaagcttggtggcgccgtttgttttttgtttattcactaagttactctaatttagttgtataaatacactctcccatttgtgtatttcttttcatcaaccacaaagatctctctacttcaataaatctccaccttgctttaagaacaaagtcttaacaa

SEQ ID NO: 4780 - DNA, 2000 bp, Arabidopsis thaliana
tccttttttagttcactaaaaaaattagtgagtggataaaaataattttatttcttggtgaaaattctaggaagagcatcattgacaccaccactattctcacttgcttttctttatttcccttgatatgacattcaattcacgagttgtttttttgttccttttctcctgagtcggctacttttttaatcggatgctttgctttgtactcttttaatcacagccgtcacatttgctatatctctattcacttctacggctttgattaaagcccaaatttaaaccttatcgtacgatctcaaaatcttgtgcaacttcaacatgtgtccactgtctagtttgtctgtgcggatctagttagtgcggttaagttaaaccggagaggttcaggttatgttaaccatggttaaggttttgtctgacagtgagggaagaaagtcacggagttgggtaaaacggcgacaagatatgactagagacacactccttcttcaatttcctaaattacccttccttacttgaccggaactctcactcgagatttttctacgtcggctttatcgtaatatcggtgtcacacgtacgtgggagagacatgtacattcttttccccctcctgaaaaaccaaataaaatagcttcaatctttggttgaaaaacttgaaatatgttcttgatttacgctgcaaaattatgtacattttttaagatcaaaggaccaactacaattgtttctgctaaagtcttttcttttgttatttttatcaaaatatgttgattttgtagatttgagaaaagaaaatttttgattaggaaaaacaaacaaacagttgactatttacttggttggggaagcaaattaaattataccatcgtaatccacacgtacacattgtttttaacttttgacaaaataattgtttagctacctaacaaattgacatattgtgtggcaaatttataaataaataattacatatatctcactgagacgccatgcagattcgtatgtttatacaatgcctcacccatttcttgaattctctcaattgatcttcccatgatgttcatttattatttgctttatgtatatctttgtagaatggtagtattactattaaagtatcaaattaccatgacgacctatagaaaaatgtttttagaaaagcatagggatatgtgtcttatggacagtggataagagagtggtcctaaaaacagaccataaattatgggatcttcccttagttcctttattgttatcatattttaattactcttattagtatttttttaatggtcaagttgtttattggaattacgcatttaattatttttctaattcgtatacttgtgagaaacagaacagcacgctttgcttcttttactagacaaacccttaattagcgatatttgaggcagaaaaaaagacaaggttgcgtgtgttttactccacaaaagaactcctaaaaccaaaaacgttaaaacccacttcttttttttcacagtattctcttttcatgtcaagaacaattactgtttttcttggtatgcaatctgtaaatttattgtagttttcatttctacttttggggtttaggagtaaaagtggagtcactctactttgctttacctttttctgagtttttttttgttcatacaaatccaaatttccttttctttgtattcctattttttctcttctcgtccctttcagaatctttagagagagagaacaacaaattgagaaagaaaaaaaggtaaggctgtgtgagagagaacccaccaaagcgtgcacgagagagagaaaaaaaaagctttgattttgtataaaatcccaccactgctctcttaccataccttcattacacatctctctttctctctctcgctctcagttttgtgggattgtttctttaaaaggggttcttagggtttagtgaagctatagatttcaatttcatacatagttaacgtatagaaggaatcttgggttgatca

SEQ ID NO: 4781 - DNA, 2000 bp, Arabidopsis thaliana
agcaaaggaaatattttgacaaaaagataaaagaaataagcaaaacataagcaaaatttcatttgtttttaatatattagacataaatctatttattttatataattaattggatgatcatgagttaattaacgtgtaaaattgtttgtttccaaaactttcaatttgtatagcaaacactttgacaaatagaaaattctatattagtacaccgtaatacacattcaataaattttaatcaacgaatgcatgaattctcctaaacctatttatcaatgaattaatttgtttatcagtgtttcacacagatcatgatatgaaaccaattcttccctagtttctaattacatccgactcgtaacacgagttatcaaaattgagttgcaatacatgttagaatttgatgtaacttgcagtaaaaattatgtggtataactgcagattgaagtagtgaatttgctgtagaaatatgagttaacatttttcataaaatgtttgactggtaacatttatgatgtattagtagcagtatatattattaattttttaataataataagcttatatttataaatttaataaataaaaaaagtttaaataaaatgatactatcttaaataaatttaaaaattattttgtaacataataaaaaaatgtgcttatatttgataatgagctttacgtacctatatatacataattttgtgaatgattccacaaatatataaaaattaaaatccataaatttaactagtagttataataaaaacattttattttgaaaagtcaaatagaaataaaaattaaggaaaataattgaccaagttgttggcttactagttaggattgcttagcatcattattagaattggaaacaaataaaaagttttaaaaaaaaaagaaaaaacaaaatcagtcgtgggtaggaagaaaaaaaatgaataactcaactctaactcatgagattttccatgatgttgaataatgttttgagttaacaaattaacaaaggaaataattcaaaattgtaaatcaaacataacacattctaacgcaaacttaacttcaaaaagaaaaatttagttcatgattggtaacatttttgaattatttatgagttatgtacataactcaactcaactcaattataactcatgttaccaatcaaagcattaatatacatttagacaaaactaatgcactatatatttacattgacaaagaactaacaactacataaataatcccacaattatatagttagtactatatagagagagttgaagtaaggaagcaacaaagaaaagagaggcttgactatttgtttttgctgctagctgtttttgagaaaagttacacaaaagctgaaagctaccttagtaacaattcagttcacagtattttttgcacacggtttaaaacattagcttatttggatggacaaacatctgattacaaactcatctttttgatgttactttagctattttgagtttccatgtagatgatcacgtaatgaggttagtttgaatgtctttgtcagctgtaaaagcatccagctcaagaaccttgtaatgcaaatttacttgcatataaaactcagagggtggaggtgatacagagagcaatttagttttgattaacattcagcaaaaaaagaaaaaaaaaagttttttttaggtatatgatgttttagcagatatcttttgatgaggaatgccgaatgagacttctaatatgggccaaaataaaagtaggcccaatagtccaatgccacacacatttcaaacatttatccggttgaaacataaacaacttcccagtattacacaaaacccttgaaagcaaaataaaatattctcaggaggcggtcacagtcacaaaagtcaaaacccttggccagtttttgttctatcgctttcacacagacacaaaaactgttttaagtcccaaaaatcagaccagaacaacaaaaaacctacgaaccctttttgtcttcc

SEQ ID NO: 4782 - DNA, 2000 bp, Arabidopsis thaliana
aatctaattatcaagacagagttatacagaagatagataaacgatactagtgttacgtttctatacaatcttttgaaagtaaacaaaagaagccatgtggaatcaaaaacattcgaagcatgggaagatcaaataatccagtgatggagctagaacggaactaaatcaatcatgaaacctaaatagttttttaatctttctagaatctcttcttatcaaaaaatttccttatttgtataaaaagcctcgggaaagttaacttctcatcccaaactcattcctcagtttatctctcgactagagagtgaaggaaaaatcgaaggataatctgtttcttccagcacaagttaacttgcaaggtagttttctcccttcgatttatactgtcttgctcactttcttaggctatttttaggacgattcatttttttaatttgtatgttattcatctttttagggttcttgtcacattttcggccttaatttgtatgtgtaaaaatataaatagtgaagtagatatcattttatatcgtctagcactctagctactagcttgatctgaaactagtatatatataaattatttgaatgtcagcttttttttgtgaaagtcacacatcacatggtagttgcatatttcaagaactcaactgaattcgatttaaaatttctccaatcataattcataaagatatgtatttcaatttttttaaataaaaatagattttcctatttaccatgaaattttttactctttttatttgttctcatataaatagagtgataaactattttacaaagttcatttatgtggaaattgataaaatgacaagaacatgaaaaaaagacaaagatttttagttgaaatctgtgatcgatcgaacagaatcggttcagctactgtttttgtaatagaacaactgtccatttttataccaaaatgactaaaccacccttagaagatgcatgtgttgtgtggtactaaaaactcaaaaaagcattgaaactttacacctttgtgtcgttttctcaattttacccccgcttcatttggaattgtcactctcaaaattggcgtattttccagttcatatcttcattcatctatggccccataaaccataactctttgaaccatatttaataatgttacctgcatgcatatacattcatataaaacatgtattcattatcatgttagatatgtctagtctattatttcccaaaagaaagacacctaagagagcaagattcttgttattcatgataacatttttgaagattcaaaaaaaatgagtgattgatgaattatttatggtcagcatctagtaaaatcatatcgacatatccagtcagccttagtagaaatgcaccaaagtgatatagagtggatttctctcgatccgtgtagaaatggaccaccacattgtctgtttagaatattatatttttttgtataaaattgtagacataatctcttattaataaatatttaatgcaagttagttatttttaattttatgaaaagaggttaactccaatatgtaccatactacttgaagaagttaaatgacaaaaaaaaatataagtaatactaccatttccatatattgtactgatatttcaaactttaatcaactttcctttctatttctccttctttttttatggtcaaacccattctgtttatgactaaacatatgacatatctaaccgttattaattagttcacatatcacatatttgtatagtgttttcattttcagtaatcaaaccatccatctaccacaaaagaacttggtcatgtgtccatttttagaaatcaataaaatattataccatatatttatagtatctaactttaagagaataaatatttttatttgccgattcatatacacacacatgcgtgtggtatctatgtctatccattaaactaattatatataaacttattttctggccacaatttttgtttcgtgtatagagagagctcaaag

SEQ ID NO: 4783 - DNA, 2000 bp, Arabidopsis thaliana
ggccggaaacaacccactggcctttacacctctataaaccaccaacgcaagttattttcttttcgacattgaaatttaatatatgttttcatcaatctcaaattcatcacaatgcagtacaagtgaattaactaactacactgtaaatctgtttgggttacataaattgtatagcgtgagctacatacaaattttctttcttttcggtgtatgtatttttgtgttggtttttgttttaggattctcatggcttttgaattgtttctagttatgcttcatgtcaaagcacaatttcatttaggtttgacaaagctagtcatagtcatgaaaaatatagggagtatattaaagtaggattttgctcttctcctattacacaacttgacatgctttttgataatcaatatttataaatagactattttatttaaactactcaacaaaaagacccaatttaattgattattatttaattatgaaaataaaaataggactattatgtttcttttctttaatttttaaaattctgtttctaatttgggctgcttagttgagtagtaatgtagaggactgttttaattaattactgaattttttattttaaaaacaatactattagtaatgtaattttaaaaataaaaaatagtattgtttgcatggaatactttgcctcataatggtttcactttgactattagagaatgggaagaagaactgtttgaagatgttgaactggttcttcttcctctttgtcggagtaatctgaatcgaaatcgacgacaacctccattgaaaaacatatatatatatatgtatagatttaagagaaacctagtaacatatttaatcaattcaatatttgatttattgtttttaaatagataattaaacattttaaaatagaaaaacaaaaccagttcaaaaccttactttatgtaataagttagatacttaataaacaaataaaagaaattaggtttgcaagaaatctaacatgaatggaaggttaggtaggcataaaaatgaaagataagtaaggaggttggtaggaagagtggtggaggatcaaaagagtatggcaaaagagttaattgccaaatgcaacgtcacttctttcactcctcatctaactctcaacactatttttgtatatataatcttgaacaatcggttatctcaacatttgcatattgtctacttttagattttgatatctattggaactcttactagctcattcatccgtcgggtaactttcttgacctctctccatcttatcttttacgagtcttaaagactttacttatctaagaaaatccgttttagtctctcaaaattgatttattagatggtatattctagtcacaacaactattttttggacgagaattttacaaaataattgaaggatacttaactctttcttactaaacaaaacaacttaaatctatatccgatatgaattcttgtgggtaaagaatacaaatcatgtatattatctggatatccaaattattcactaaaattttataaattatctcaaattcttctaaatttgtaaattactcaaattatcaaaatcactaatacccaaaatgagaagaaacatttattgcttaaaagttagattcttcccacgtggcccggtttagttatagttgccgacgattaatttccggtcacatttttaacggcgtgagtttgtatgtggcgtaaaacatgtcaaaatgcgatattttcgtaacgacgttaacttatacaaatacgacaagacaaggttttggcaacgaggccaatcagaccagacttgtgagaactgagaacgatcgatcaaaaatctctcccacgataaaaatgaggaccctgaagctcattgtacttaacgtcttcccctttccagaaaaatcaaccaaacccatttcagtttccccggaaagtttttgtctttcaatcaccattagaattcagctgcaacacaagtgtttgcaacagagagaatc

SEQ ID NO: 4784 - DNA, 2000 bp, Arabidopsis thaliana
cgcaattcaaaagagtggtaattgcaaattaaggccttgaatggatgcagtttttaggatagtttttagattttgattttgcaaaaactaaatatttatcaattcatgattttaaaaaaagtagatttttagaaaatagggaaaccagattttagaagattttgcttatttcttcaaaaaatccaaaaaccaaattttgtaggttttaaaaaacatttacgtgacatttttttttcaattttgtttattattttaaatgttacttttaccatttatcaaattattcaaaactaaaaacgtttgaaaaataataattatgtcaaaaacctaaaaactaaacaaattactattcaatattttgcaaaaactaaaatctatatcaaaaatcaaaaactacaaaaatcagaaaccaaaaactacaaaccaaaaactaaaaacccataaaaaactataaaacatttatggcctaatttttggcgtagcattttgttttaataagcagtttcatagttgatcatgcaaatatttatagttatgaaatgaattggcgttaaagcatgttgaataatagttactgtgaaggtataaaatagatatatgcacagtaaaaccttatatatatatcactgttttatttttttcttgttattggtttctttttaagaagttccaaatgttattttaattgagttttatatatttttgtcctaacattgctaaaaaaaaaaagatattttctttcaggacaaaatttattattgacttttataaacattatatccagccttttccggaaaatcaaatgattctgctactctaaaatattcatatgttcacatcttagtttcattcatgtttaattttggttataatacccataatttagattcctttgtttttttatatgtgaacatattttctcaaagttagttctacatctaaatggaacagaaaataacattggattgattttaaataacagcagtttatcaaattaggaaactaaactaactatcgtgtaaaccttcttagaattattaagtaaatcgccggatcactctattctctcgtggatgtcatctcacgggttgttttagccaaccgcaaacctcttcttcatcgaactttgtaatttcaaatctcaaatgcaagaaataaatcaatacaaattgttctaaccaacattggaaaaaaaaattgagatgttcttgtctaaattctcttgcaagttgggattagtcatatataatccatatgagatctaatttgtattcatactgtttgctttacgtcacaaatgacacaaccatgcatatagacaaacctgattcatccagggctttgatgtcctcttatttatgcataagaggatccaaaattttgaaaacattcacattgaacatttttttccgaggaagttcgagaattttgttagcatgtcttcctcttctgggaccagtttgtgataaaacacatcctctcggaaaagagtgtagagcacaacttcctctcgaatgtactaagaccactagactaacgtatagaagctctcaagtaaaatggctacgatccaaagagaatctgaaggtatgtgcaatgaggtcatgaaccatcatgatggtggtgataataacagattaacagcattgacaatttgaaaataatagtaatatgaacgcacaaatcatatttatttcttaaatagaaatgttttacaaaaacgattaatgtctaaattaattcaaggttctacgaatctacataaaggaaagtagaaaggtcagaatttgtatatgtagataagggcaaataaataaataaacagatattttgtagaattgcaaatatatgtgaataatcaaatataatagaacaagttggtcctcttcacatccttctaaaaccctataagtacccacaccctctcttcatatatcttcatctctcactctctcaaagacactgaataaatccttaaaacaaacttttgaaagaaaaaa

SEQ ID NO: 4785 - DNA, 895 bp, Arabidopsis thaliana
atcattcggtcttgttatatataagatacaagtaaattcacatctctgatatgattatcggagtaacatatataaaaaagaggaaatgttatttaaggagaggaactagccgacatagttcctgagttgtaataatattaatagagaggagtatgtgggaaaagtttccataaaaagatgatggaaacgtaaatgttgttcaacattttggtgtggaggtgacttgactcttgttttgtttagataataaataataatctgagaagaacaatttgtgttcttcttttcttctgttggttttgaattattggctaaaagaaaagccacgtaagagcatataatgacaacgcctacgtacgctttttagcgttcaatttagaccttaagttttgaaagattccatgtcttcgttttaaaagtcgctttcaattgtttgagcatatgtttcgtagggagcactaagttggtatacataaaggtattgatcaatctaaaaaactcaatggtttaattatattaatgactttagcctaaaaaaacttaagtcagtgtaaaacaatatcgatgtgtgattaagaagagatccaatttaacattacccacacaatcatttgattatttcctcctctccgtatctgtgtctctcttctcttgatcttttagtgttcttgctttgtcgcttcaacgcttaaggtaacactgcttcttctttgatattcgcgattcatcgaacgatttcatcattatagacaaacatcctatcgatcgggtttgtttttgctgattcgagattcactgtttgttagtttcatttcgttattttgcttcatgtggtgttgattgattattcgattttcttttttggcagtttggatttgtgtgagtctgcataatc

SEQ ID NO: 4786 - DNA, 2000 bp, Arabidopsis thaliana
cccttgtttttcctaatatgacaaaattgatcaataaaaaagtagttacaattgttacaactttttattgcaacttttagttaaaatagttataatttttattgcaattaaaatagttacaatttttttattttggttatgtttttttatcgcatattttcgttaaactaccgcatagtttggtaaattttttgtaatgattcaaatatttaaatatataattataataatttagtacataaatactaggccagagcattcatttatattcggtttgcttctttcggttctaaactctgaagatccataagaaaccgaaaaagttatggttcaactcgattcggttctaattattttatccaaaatattttctaaaaggactgtatctaaatatcggaaactttttttgacaaaattataataaaccaaaatatcagaaaaattaacaaaaattaattagattagaggtaaaaaaaaaatgtattggacttagttttgtaaagggttgaccaaacatttttttgttctattcgggtatctaaaacagaaccagaatccttttttggtttggtttagtttggtttttcaatttcggtttttgttcctagctcaatatgcaaaatcaatattattttgtagtttaatatataaatacaaaaatttgtcgaaaatgagtttcagggtggagttcatatcctagttccacataatagtagagaacacgaaagaactttgacttatcaaactttacatcaacatataaatctaatatcatataatatactattaaaaattctataatttatttctagagtccatccacacacgtttctgatatttgttttttgtttgtaaaagaaaaaaggaaaaaagaaaagtactagacatctcttttccgtaaaatatatactaaaaatataaatattttattagcatttcattatcttacctgcatttcaactatggcaaaagaaaaaataacagatttgaaaagaaaaaaaaaaggaaaagcattcaacgttgatagtatgtaaactaattgatgctctaaattagcgttacatttgttatgtaaaataagaaagtcaaagaagcagagtaaagattaggtgatacttgcaaagttacctttcttttccaaatgtaagtaacgtctcaagtttatcaaactaatagtttatgctttacatattttcccaatctataaattttatttgtaaacagaaacaaatgccttcgaaactcttgtatggaaaaattaaatccaaaaagttagtatattattagagtaaacactcataacagaaagatctttttcatactccaatatggaaaattttagcatcaaaaataacatttttttgttgttgttgccaatatatcagcatttaaaaaaaaaataaccattcgcaagtatagaaataataaagtctcagtaaaagtgaatgcaactacaagtctctgggatggcaaaattgttagcaataattctgtgtttgtagtacataaaataaaattgattaattgctcgttcttcttttattaataatccgtgttttgttttgtcctttctcttcaatctgggtttggtggggaggttttaagtcaagcgtgcgatatatatatcatcaaaacagacatcctctgttcttgcctcttcttcttcttcttcttcttcatcttcttctatatattggtgtttcatttgttctgctttaaaagtacacaaagattcatcttttttcggtcctctgattgggcaaaagactagctcggtcgtgttttgaacaagagatacatgttttgaaaaattcctcgcaaaagaagagaaagaaagactcaaacttttgtttgaatttgataccattttttatatatataccaaaagtccaagactggtttcatttttgggtttggtctgaaacctctcttcgtgttgtttgttcatggtatgtcttaattagggtaaaaaaatacttgattgttttctctcaatcatc

SEQ ID NO: 4787 - DNA, 2000 bp, Arabidopsis thaliana
gttcccgcaaaggttcagaggtatttttcgatctaaggatagatttaggaggatatttagattaaaaaggattgcttaggagttgtgttggcatttcaacaatgctagtgtagacggtccaatgcgacacccagttgattcattgacttggtctcaaataaaagataagttttcaaagtattctactaaaccaaggaaccttcgactcggcttttttacagataggatgaactcgttctctatgcagaaaaaagtattgtacatgatcgatgttgttagtcaactacaacatgttgccgactatgtgtatgaaggctgggaacatcatgatgactatgctcttccctagaccaactgcaccacacaacaacatagatgtgtatcttgcacctattatagatgatctaaatggtgtgtggaaagaatgtatagaggtttatgattcttatatgaaggagaattgcacacttagaactatattgttgtgggctattagtgattatcttgccttaggaacactggttagatgtatggttaaagggaaataggagtgtaacatatctggtaaggacacaccaacatgcatgttttattttgctttagtcaaattttgacaacacgactactggaagtgcacagttaatcgtctgtagtataatgggctttctaaacccattccaactctcatttagtatgatattgtcctctttgggcttatatgctcaagcccgcaaggatttgttattgggttccttcccaaaaggtctcatactagttggagttggacttggcttatatattagaaactctttttctaaactttcgatgtgggacctttggtttgtacccaacaatctccccttcaaaccaaagaccacgaacttggacctccttcttgaggcaccttcttatcgtgtcatgtttgagagattttcccacatcgatcatagcccaagccctaggtccagtgtttcaacctggctctgataccatttaatgggctttcaaagcccattccaactctcatttagtatgatattgtcctctttgggcttatatgctcaagcccacaaagatttgttattgggttccttcccaaaaggcctcatactagttggagttggacttggcttatatattagaaactctttttctaaactttcgatgtgggacctttggtttgtatccaacatagtatttatggatcgaattccattggaagagaagtaattcaaacaagtctgtcagaagagagtaaaactaggacaaatcaataaaagagggggaaagggttgttattgtgtcacagttgtaagtaagtgaagcaagtaaatagtaagtgatcaataagagacaaaagttggacattcaagggatcgtaggggttcaatgatcttcatgatctaatcatgtttatttccatgttttcgagcatataaaacacataaaattcagctactgaggaaaaatatataaacgcatatatacatatgtacacgtccacatactttcacgtttaggttttcgttattagggaagttggacttttaataggtttactgatatttgggtctcacgtaaagcagaccggctctttggaggtgcatgaggcgcatttgttctagatccaaattttttttggtaaatttaaggatctgattagtatggaaaagacctacaatttttttttttttagtatgaaaatgtcaattttaatgtgtttttaaaaaattagcataaaaagggtccaaatttttgttttatagtttagaaaaagattaatttttaaaatttgtacagggactataaatttattgagttggtagagacaaaaagcttaaagtttacacaaaggagaaaattatcataaacacaaacattatcaacttttctttgtttgatattaaatttttaatttataattttttattgttctaaaataatataaataagtaagtggtagtttgacaataatctctatcatctactcaaatgtgaca

SEQ ID NO: 4788 - DNA, 587 bp, Arabidopsis thaliana
agctttgaaataaagagataaattactctttttcaccggacacgaatgagatatcgtaatttggtaaacttgatagaagatgatcagtgacgttatttctcaccaacactataattccattttaagaaactttttctcattttagttacagttttccagtttgaaatctctcacacctttacgactagactacaaaccatatctcttacccatcaactcttaaaaatcaggcattgctttatcactcagtaattagtatttgacgtttagagtgtactcgattagatagatagctttgcgtccaattctctactttctatttaccttgtttcgtatcgaaattgataacgtaattgactataagaaactcttttgccaatcacttgctgttgtgtttttatgttcctgaaaacagttcagtaactggttttcttataaatgtcacgaagagcttacattttcttataaattacataaatgaattctgccaattttctctttcagacttttcttaaatttgagctcttcgtgcagctaactgttgcctattgattgattaactactttttggttagtttgggaagaaa

SEQ ID NO: 4789 - DNA, 2000 bp, Arabidopsis thaliana
cattacttttttaatagtggtcgtaatatataaatcaaaaagacttttttacttaattattttttaattctttgaaacagctaaacgatttgaccatgcaaaagaactagtctccaccaacgtgtctcacgtggatcaaaaacaatgggttttatgcaaaaaaaaaaaaaaaaaaaaacacattcaaaatcgatatttttacaattttagtttttagatttaaaaaatagaaaataatttgattgaatctaaaataatatgtaatatatctaattttagtttgcaactttacagtaaacgttttcacgatcacatatatttgtgtttaaatattttaaagatatagttgaattcatcatctcgagagattccatttgatatattatttatcaaaattttaacatttgacgataatgaaaaaaattgaattgcgtattattttatattttataggtttattttgcatttctgacataaataaaattgtaaaaatagacgacttcgaagtttgagcttgagatcactaaaagaagttaatgaggtatgttgtttgaaataaatttggggacttgtctcccacaaaaactccttatggattaaatagatcaaggcacacctactcaaaagagtcactatttggtaaataaaagaaaatactactttgggctcttagatgtggaagaaattactcaaatacaaaggagtggccaaacaattttgcaaagttgaggtaaacaactggaaaaaagtttcattctggtatgataactggtttacaatgggctgtttgatggatatcataggagagaggggacgaattgagtttgacatcttaaagcaaatgtcgatggcggaagcatggacataactgcaaccctaaaacaaattgaaacagatctcaccatgaagagacaaaatcaaaccgatgaagaggatgtggtattatggaaaggaaaaacgatgtgtatcaatcaatctttagaaccaaagacacttggaatcacactcgtaccgatacaaataaggtagtttggcataaagaggtatggtttactcacacaacaccaaagtattctttttgcacatggttggcgatccagaacagactctcaatgacaaacttctttctctacagcaactgcattgaatcagaggatcatttattcttctattgtagctatgcagctgaagtatgggaggctctaactataaatatctacaaagcaaactactcgacgaactggacatctctaatcacaagcatatatagcccatggcaggagcgtatggaaggttttattgcgcgatatatattccaagccacagtgtcacacaatttggtgcaagagaaacatacgtagagataaagaaacaccaaaccctctggctcggctcatcaagtggatagacaagcatagcaaaatgttccaattttaagtaagaaaaacaaaattctactgacaatttcaaaaacaagataagtaaaagtttaaatttaaaaaaaatgaactaaaaagctttgtcctattgatcacctaatgagcctttaaatttctaaccgtcttaaatcctattactagttaaaatctttaaattattttaaattaaagatataggttacattatttaaaatatagatataatcaattaaaagtttaaaactcatgttaaaagcatcttaaagggaaatgaaatattaatacaagaaacaaatatatatatgtaaagacatattttcaccagcggtccaaaaaaaaggatatattcacatattaaaagaaaatattggggcaaagtggataagataacatccaatgagaataagacatatcaaaattcatatccctgagagccacaacaatcttaagaaacagatcctctgtcttgccacatcagcaaacgcaatctcaagtttcgtagattgcttatttcttcatcacacacttcaaactcgattttattttaattttcataagagaacaaccaagacaaaaagaaca

SEQ ID NO: 4790 - DNA, 2000 bp, Arabidopsis thaliana
taaaaatcatagtaattttccggcgaatagaatgcttcgtcggagatttcaccaccaccgacaagtagttccccggagagagaaatagagagagtggtaaacaaaagtaagaaaatgggcttctttagttaaagtcgattggagagggggacactgtaagattaaagcttgagaaaccctaaaagagaaagacaaactttcaaaaagttcttcgaggagagagagacgacaaagtttcgcgtatatagagagagagaagaagacaacaagatataatccattgagaagaaggcaacagtataattaagtcgttaatcattattaattagcattgtttttggctaattaattagcgttattagtcgttgttaaatgaccttacttacttactggagtagtctaattttttctgggtcccactttacttccaagagtgtgaaatcacctgcggctggtcctactataccataaagtcaaaaccggaccggttcagttctgtaaatgttgaattctaagcaatggatttaagtatttaaccgaaccgactctttaaaaaattgctgttcgacaagtttatacaattattactgttcaattcttcatttggcattatatgatatatcgatttagttgtgacttttgagcatgtgtttttttttctgattctaaagttgttttggaaaagattgtttgttttcatttgacattatatagttaagcatgttctgttatctgtatacaaatcatcgtgcttgtggttttgggattatgtgaagtaatacagcaaagatgcgtaatttattttaagtatcaaaattattctcttatccacattgtatatagtcaaaatatatattacagactgaattaaacagacttaataataggcaaaatgtacatatatttgcattagaagatttcaatatatgtgttttttttctttcagaaaggtcatttgactcataagttataacagctagcttatatagtccttagtccttactcatgaaaaaagaataatttgttttgttatttggggtctactactaacattagaagcagacgtgggatttaatttgatttattaaaattgtggtgggtaatatttagactgaatctatgaaatcgatagcttgtaaccttactcactctcaatttaattatattagttttgtttctcatcacgactgagacgtgtaacgaatatatcgactgatcaaccactagttattaatttaaacgactttaatttgtattaatatcatatcttaatgacttgagtagaagaataatagaataagcatagaaaacattgaccaaatccttgtgtacgatacaatcatgtattatatacagatttatttgttactagtaaatatgattagaacttgcattagacaatggtcaagtttgttgatgtttccagttatggagaagccataatttgagtagcattagacattgattaatcaagaaaagaaaaataatatcatctactagtgtcaacactacagacgcagcgagcgagcaattatagacgcagtatctaaacgctgatcggtgtacgaatttgcggttcatttcaacgcttggcaaaattcacaacgtggaagacattgcgagtttacgacaaactagtggggttgttttaagtaaactaaaacttgtaggggttttctcaaaaataaaataaaataacttgtaggggtcacaaatgaaaaataaaaagtattgaatatcctacgtggcatttgtttttttcatctcctacgtggcattacgaaatgaagaaaaaactgatctgacggatctgcttaaccagttgaagataacgttagtaaggaagatatccagaccaaagccacacaacattagccacgtgtcataaccacaatcacttaccggatcttctctccctcgtatttgaagccacacaacatgaacattagggtgagaagagatcgagagaagaatagtttgatcatcttgtgagaaaaata

SEQ ID NO: 4791 - DNA, 2000 bp, Arabidopsis thaliana
caacaaagttataatgatcctgatctctaccattacgtagtcttctctgacaatgttttggcctcttcggttgttgttaactctacaatctcctcatcaaaggtaaatgtttcacctttattctctttctttcaacatgttgtggttcagttcctttatactcctgaatttgatatctggacaaatgctttaggcttctactgtggttagtaccatatataggatattgtctagttatgaaactaggaaaaggaagttacattttgtgtgctctttgttcagtgaataactttatctttttttaaattacagttgagaaaccttgcattgttttatgttttcatgattcaaaacttatgccccatattgcaagcatcttacacttgttaattcaaaactcaggtatcattttaaatcatgttgcaagcatcttaaacttgttaatgcaagattcccgatccaaacttgtgtttttaatgctcttttccgaatctctgctgaagccacatgtcttttaacaaatgatattactgcttgcaggaaccggataaaatagtattccatgtggtgacagattcactcaattacccagcaatctcaatgtggtttttactaaacccaagtggcagagcttcaatccaaatcctaaacattgatgaaatgaatgtcctgccattgtaccatgctgaattgctgatgaagcaaaattcaagtgacccaagaatcatttcagcgctcaaccatgcacgcttctatctcccagatatcttcccaggtctaaacaagatcgtactcttcgatcatgatgtagtagtgcaaagggatctaactagactgtggagccttgatatgacggggaaagttgttggagctgtagagacttgtcttgaaggtgatccttcatatcgttcgatggactcattcattaatttctcagatgcatgggtttctcagaaatttgatcccaaggcttgcacttgggcattcgggatgaatctatttgatctcgaagaatggagaagacaggagttgacttctgtatacctgaaatacttcgacctggtacaacattttatcaccttttagttctctgcatcaaaaattcacactgttaccttgatgagttttgaattcaaaatggttaatgtggcttatgtccgtcaatagaacatcttacatatgtgtatgttgtgaaattgttgttttggttgcagggagtaaaaggacatctgtggaaagcagggggattgccagtaggttggttgacttttttcgggcaaacgtttccgttggaaaagagatggaacgtgggtgggttaggtcacgaatcaggactcagggcaagcgacatcgaacaagcagcggttatacactacgacgggatcatgaaaccatggctggacatcggtatagacaagtacaagcgctactggaacatacatgtaccttaccatcaccctcacttacaacggtgcaacattcacgattgattttttgaaacaagttaccacaaaacttagattcaattcgattcttttcttctttccaaaatgttataattagcttcattctttaaacgatttcttgtgtaaatctttgttctttttgacacaacacacaaaattctcagagcagaatatcagatatagttcacagcaacataggtgttgttcgttctttgggttgttatatattgcaatctggatgcagtttattatgatgtatcagtagagaagagagaaaaagattgtgttggagggaaagagatgaaatatgacacgtggagggcgtcgattggtggagtatggatagaagcatatccaagttagatggcttgtgttggttcgaacagattttttatccaccacatatttatgtttgatccaaaagccaacacaagcaaagaaattaaaagtgttcttgttgctgtagaacacaaacagaacaaacaaaaaatcaattgaagagtctctcagtcgttaggggaagcaaatagagaa

SEQ ID NO: 4792 - DNA, 2000 bp, Arabidopsis thaliana
atccttcgagattcttgctatgcgactgctctacacaaatgtgcatcgttttgagtcttgtactcgaattagtaaaaccagaaatgacatacggcacaaagcccatcgttaaacgtttcgaattgagcccttttctcgacttcctccgaatgggccgtaacaatgggcttcagttgcccttatctatcgtaaactgggcactgttttggagagaaattgtttcatatttgtggaatgtgcgccgttttaacgtaggaaaagagggacgaactactcgctgttcagaatcggtagtaggacttcatgtcgttttataaaggagagttcctaaaaacctaaaccctactttagttctactatataaatcaaccggctttggctgagaagaagccattagcacaatccgagtaccgaatcaaacctaagtctctgtaaatttcctcgttttccgtagatttagttctttgtcatcccatcttattagggttattcgtttaatttcgtttgaatcagttgatactctctgattttccaatatgtgtttgaatcggcatattaatctttgatcgactcgattttgtgtttttagaaaataatttagatttttttagagaaggaaaaatattctcagtgatgaagaaacaatagatgacgagtccgatgaaatccattcataaaatcgtggggacaaacgaggcatttgtctgagaggattatttttcttcgttttagcattctaaaatatctaggttttaggaacgtgtataaaggggatttctcagtgatgaaggaacaatagatgacgagtccgatgaaatccattcattaaatcatggggacaaacgaggcatttgtctgagaggaatcctttttgttcaattagttttgttttaattagacttagcaggaagaagaaaggcatgatgaggattgttttattgtcatctgattcttattgatgaatctatacctcctactcattctgagtgccttctcttgctcttaattttcagtcacagatatcattgcattagtagtcactaaattcggattcaattatattgactctagggaacactacatttcaagtgaatctacagatactctaataatataacacaatctgctaagaccaagtgataaaccaattgaactaacaaaaaaaataagtttatgaaatcataactatttcttgatattaaaaaataacagcaaagatgccaagttcatataacataaggccttcaaggagaaaccataacttgtaatttcaaactgtatactggaaagcagactgtgctcaatgtggttttggataattccctgcatcctagtcctgaagttgaagcaaaacctctagtattggcattcttacatatgatgagttaatttctgagagggacgtacattctgattcaggctctaaaggatcgattaagatttttaatttatcaggaccaaatcagaaaaaatttatatgatttctatctgtatacttagaacagcatccataaaagaaaaatgttgttgaagatcaattggacattggacaaaaacctagtgggccgggccttctttgcatctactacttgaaagccttaaaaaagaaaattaattgaaaattaaattttacatttaagtgttagcatccaaggcccattagctcagttggttagagcgtcgtgctaataacgcgaaggtcgcaggttcgaaacctgcatgggccacctttaatgtttttacaacataacaatttttgattattttatactattatacaggtcagcacccctgactgagacagtatccatatctccacttcagatttcgacacgtggcaacaaaaaaaaccagacactccgattcccacgaaacaaaccaatcaaaatcgttgccttatcccaatcttatctcagcccttttgattattactctttagtctttactttgctcacagctttggatcaccaaaaaaaaaactcaagagagactttgtggcc

SEQ ID NO: 4793 - DNA, 683 bp, Arabidopsis thaliana
tgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatggtaagtttcagttcttggatttgtatgattttgtaatgtgaatagggatttgaagatttacttacttttgaaattcaggcgtcggagaagaagctatcgaaccca

SEQ ID NO: 4794 - DNA, 2000 bp, Arabidopsis thaliana
ctgaccaaactaatgaagtttaatgttatttttcgtcaagattttaatatattttagtcgtttcttaaaagggaatcatgtcctagtgttttgtttacaagacaataagacatgtcatatcatttgttatacatatttacattaagatttgttgttttaaaagtttcaaataaatgctaattaggttgctaattatcagaaacactgaactcacacacattttagcaaaagcaaaactcattattacaaatatcaaatccatggtctttgaatcaacagacaaaatgttactaacgtgtctttatatcatatgagaaaacggttataagaaaattatgatgaattcttatcatccaaggccagaaattgaccaatgacacttggaaggccacatatctctacttgttaggctaaagacaaaccaaaccttttcaatcgcctcaaaccataaagagaaaaagaaaaatgagtaagaaaatttaatctttgccttctttttttcaaaaaatctgtcaatcttgatggttcagtatgataaaatgcgcaaatttaggatgatatgtttgtcgtattattacttttttctatcatgttcaatatgtatgtagtaaaaggcatttaagagagagcccaaaatttacaacaatatatcaatttgcagatattgggcctaactggcccactcgctactacaattattagacaggcttggcttgccctggatacataaaagcaggcacacaaaaaagcaaatgaaactagttaatatagttaattgatatattgtagttcgcatgaatagtttagttaatatacaataatacacctataacaaaaataatacacattggagacctaaagtcacaaagcatttgtctcatgaaggatctttcccaatcggtagccgaaggactactatagatcgagttaattaggttgagttcggtccacaacggtcgaatcacttaaccaacaatcattactcattagcagcaacccaacaacatcatcgttttcagttttcactgacaaacaaattcaaccgtctcacataaattcgtctcgcacaatataaataaagtattttgaataaaaactaaaaagtatgttttaaataatatatactagctatagtcacaaatcacaacattccacaaccttctaaaataggcaaaataattttatggaaaactttataacctaatcaaattaattaaaaatcgaaaatattaataatcaagtttatagtcacaaagtagtataaataaataaaaaatgaaaaaacaggcggagtatatatcataagcaacttcagtttagcgaaataatttattgtaattcaatacaaagtactcataattaatagtgttgtttattatttcctcgaaaatacatatcgaactttttttttgattaaaggttaactacatttaacaattaacatatcggtatacactgaattaattgtgtaaccaccatttgtaaattatagtatcaacttttagatttatcatccgatatctttaatcacaaaaaataataaacgttatcacaggttactcaaatcacatggacgttccaaacgaacacatgggctttgcatattaccacaaagaagaaaagaacaaaaatcgaattgcattacacgtatagtccaaaaatgcattatttgcttacggtttaaattaagttagggataagcttgtctttctccacttaattaatattttttgcatgttgtgcaaactgatgtttcttaacaggttgtaagatcaatcaatacataataattataataataatcattcatcatgaattatttcatctaatatttaattcatttggttgcctctcgtcagtttgtaatgaaaacatacaacaccaatatcacaatctttgccctataaaaaccctaagaccatctccacattcttcacacaacacacctcaagctttataacttctaaaacaaactcttataactttttacttcctcctcc

SEQ ID NO: 4795 - DNA, 2000 bp, Arabidopsis thaliana
catatcagttaccactattcgaaaatccataaaactatggactatagatctaacagttttggaatgtacaaaaaatagatgagattacttaaatttgacaaccggacaaataattgcgattacaagtaccatatttgtacacatacactacattctcataccaaatagttttatcattcttaagagtatacggtgacgtggcacaagaggaaccactgaaacaggccacaaagctctttgaatcagcagataaagcggggtggccgacaagtcgacaatccaatttatgtggacatcaaactcttacgtttcttcatcctccacgtgccctcttatccttatcaaccgcccagattcttcccaatacaaccaaaatattggcccactattattagggtttaatatgttatatgcgtttacaaaatttctttgtgaaattgacgtattaattaaagattagactttcaggaattagctataagaaactcaacggagtataatctatttggggaagaaaacaagattaatatagttatgttttgaacgaaccccttttacaaaaaaatgttttgaacgaataactttgacgaaggactgttataccactatgacaattgttaaaatcactatttaacattgaaatatttatatatctaaaagtgatataactaatagaataatagttattcaaagatgactgtaattatgcggcaatgggcaactatatttcactgttcaaaccttaaacatacaacaaatgttagacgatataacttaggtgttgttttttccttgtagatgaagcaacggattttactaccttttgacattgcttccattatatttccaacacaaaaagtatctgaaaacaatgcaagtgatttcatcaaagctctacgcgtaacttcaaattccaaaagaagcttctcgcgaaaatacctatttatgttatgtttcactttcacacgcaaagtaaaattcgatatttaaattaagtacgaaaactttagtacatcagaaatgattctagcatgttcaagcaacgtagttcaatggttatatcctgtggagtgtggactatgtcttatcagtttcttagactcagtacgaggataatatctaaagattatatatgatatagacgtaatcactagtcaacccatttcaaaacatttcatatgatatgagattttaaaactggtaggttgtagacttctaattcatttctatatagttatagaatatgattcattgttttgcatactagacaaaaattgttattcttttaaatattctgctggaaaataaaggattcaaatcatattttcagttacattatctcattttatttgcaacaagagattaacctcttacacgaaataatttgttgtccacaataaaaatttgattgtttaagaaacaatttgatatgtatcatttttctttttttttatgtatcataagaaaccagaaaactacttaacatttttaagaaggaagttacagttcaaaaattattgcaattttgaaactatagggatttaaattcgacgtgatttttttttttggacataaaaattcgacgtgaaataaaagatgtatatacactcttttttttatcaatcattggacgtttgatgcgactcctttggcataaatatatatacaaccgaaatataacaaatcacttcaatgcccaaagatattaataaataataattccatggggccaatttttggactcgaagctaacttctgaatacagccacactatgggattgtaaaatgcaaaatatcacaggggtataatcgtagttccaagataaactgcctgttcagacatatgaaagatatgctttgtcagagtttcagaacaagtctttcccatgctcaccacttcacctctctctctctttcttctccactgtaacctcccaattcaaaaacaattataaaccaaacttgattaatatatatttctttatcatcatctcttcgaa

SEQ ID NO: 4796 - DNA, 543 bp, Arabidopsis thaliana
ctcttaaacatactaaaatttctggaaatgaaaaaaaactgagaaacgcaaaagaattcaacacagcatcagaaaactagatctaggtttcgccgggagttaccaaaaacattagaaaaaatcgatacttacacgaattcaaccaattctggagaattttcttccaaggcaagccattgcttgcgagttagaagaaattggtaaactatgactgcgaatcagagtgaagagaatttgattttgttagtctcgattcatcactatgtgttgaatacagagatgacgaagatcttttgagggttgagagagaagaagctaagaagattgggatcaatcaaaaacgatggcgaagaaaagtctcaagggtaaaattggaattagaaaaaacatgtggagagcacgtgacacgtgggatttatctgagtttcacagtagacctgtgaagttcatcgtcttcatcgttaacttcgcagactctgttgattagtcaacacagatcagaatctgaggctttggccgagacgagagaagcagaagaagaaa

SEQ ID NO: 4797 - DNA, 590 bp, Arabidopsis thaliana
tgctcagacggaattcaagcgaacttggggcttctgatatcggatctggttccaaggaaaaaaaatcaagcagtgagctcgcaattgacatgatcataaatatgaatatgagctaactggagaaaaaaagattgttcgatcgatggatcttaccagatattctgaagaatcttccgtgagagcaaatcgagagagaagaagcaaaaagttgaggcggagaaaagctataaaggagtgttgaagggatgatgatgaagaagtagggtttttaaaatctgtattgagtgtattcctctggtttggctcggttttgtttggttttatttctgatttttgtttattttccggttaagctctaattactttcccttttattagcatgtataaatgaattacatatatgtaggcttttttagtaagcccaacttgacaagaaaaggtcttcgtcgttgggcaataacaagccgagaaggttgaatagagaagatccaaggggaaagagaaattaaattatttatttatttctgtcatcttctccttttctatttcaaaatcccaaatctaaagcactcctcgagaaaagtgtaaca

SEQ ID NO: 4798 - DNA, 2000 bp, Arabidopsis thaliana
tcaaagttcaagataaagaaactaattattttgtaaagatatcatgtatactcatgtgtgtgttgatagtgatgactgaactttccgaaaaaacgtgagaaattactgtctttctcaaaggttctactttttattttgtaaaccttgaacctttttgtctagaactcacaagactcttataacatgaatgtctttagtttcttataatttgttatcaagctttctgtctaagacagaaaatcttattgtgttctaactttgtgtaaacatatctgtatatttgtgttagaatgagattaaaaaggaaataatggaaccataattatatatgaacccaaattcacttgttttatcgaactaattaataaaatgttgctatcacagtttatttgcaagcatgttttgaaatgtttaactcataacatttttttagggccgactgtgcagtcctcttattgattaattacataatggatctgatgatgcacaaaatggctagatacgtgacgatcaggttttcttgtcatagtcgatatctttcttttttaagaattttttttatccgatcttgtttggacaaaaatcgaaagtttatctttcaagttttgggataattctttaatctttttgcatgacatgtcgtcactatcaaaagatattatttttttttaattgagatatcaattacttcatccatatgaaatcaaattaattctccatgagtaaatattgaagtcaaacttcttgaatattataaaacataaaaacttcacctttaatcattaatctaataacttagtgtcgtgccaatgattaagaggcctacggcaaaaatttaacaaacatagcctctttttaaattaactaaaaactcatatgtataaaatatttaattttgattattattttattgttgttttttaaaacttccattggacaactagaaattactaaatacttttcaaacattagtagagaataagtaaaatactaccatagaaacataaatatacacaaaaatatttccgatttatgtcaaaagcccatgtgattaaaaaaaaaaatgaataaagttttagtggaattgtagctggatatctttggaaaaatgactgttagtgaggtaattttgccaacaacactaacattttcttaaaaatgtggcatcctaaaattaggctataagatgtggcttagggcatttgcccttttcattacagagtaagcacggctctataccattcgtatcttatctttatactaggtagagtttgtactgatattatcgatatagctcaatttcaaacccaaaatatacataagtgatagtttttttgataaaacatatatagcaaagaaagttgtttgacatggtgcaatccctacaagctagctacaattcagcatatttttctaagactttggatttgactagacaaatataaaccagtagactttggtgaatgaataacacgatgaacgccgcttttaagactgtctcagtcaattcggtctttatcttttgcattaatgcgttcaaattaatgtcaaacaattctactttttcacgtacgttgaaagttctttttcttttctttttactgataaaaggctttatagttgaatgttctcgttcgttatttatcacttacacatatattcgttaaatatcactatcacttatatacacatctgataaacttgtgtatatcatgcatcgatttcttcaaaaaaaacaaaaaaagtatggtaggccaaatggtcgtgtgctcgtatccactgaatccatatagatttttcgtcatcactaacgtcacaaaattgcgttgttcaatgtttagttagtggggtttgctctgtttctgtctttgtttaatattattactttcctattttcactgagatcagattttgtctgtcagtataaactctctataaaaccaaacttttgtgttattgtctttcattagtaacaacaacaccaaccaataattaaacaa

SEQ ID NO: 4799 - DNA, 1552 bp, Arabidopsis thaliana
gtttatgtttttaatttatttaatttttgggttatattggattgtgaatcttctgagttattacactcatatgtttttgtgtaatgtaaaagatatatggttgattgttctaattaagagattggttttggtacaaagattgttaacctttgtgcagagattgaatttgatgattatgtaaaggaaatgttctgcatttcagctctaaaatttgagtccggttcagtgagagtaaaccaaactgaagtagttgtagtttgagtttggtaatcattcattagtggctgattgataattaatatgttggttgagataagagatgtgatttaatggatacggagttggtagctcaacgagtgaacttttggaatctggagcatctagggggtttagagtttgagcaccaccaacaataaagagagatttacattacaatggaaaccttctttcttcgatctaattaactatatttgtggtttcttgttggaaaagattatagtttttggcccatatacaaaaattaggccttggtttctggtaaagttgtaaatttctagtgttttatttatatcttgtgacagaatgtggtatgctatttgtgtgcatttgaaaaatggatcagttacaagtagtcacacaatcaagcccaaacctagttattagtcctccttcatctcggctcagacacaagtccagttttgtcggttcttagaaagagtcttaagagcaccctcaatggtagttgtttaatagaaagaaactctagaagctcttagagcaccattattgataattgcttaggttaattcttagaaaactttggttatgaatttaatgtttttaatcatatatttgttaagagagtctcttatataagagacaaattgaagttttcttagtttttgtttcagaaattttaaaattaattcataaaaagttctaagaactaagttaagagtaatctaagacactagcaataatgatgctcttagcacaatatcacaaaagctcttagcacatggcctagcacgatatcgaatagagcctgttgcgtagaaatctatggatacaataacttcttcattgttactattgcgggcgagctagtgaacattttcgtgcaagctaatgggatagcggaacattttcagacacctcgatgatcttataaaagaacgagtcggttctcgggtcaagatgggttaattgttttttatattggactaaagtaataatatagcccacgagtttctgaaacagaagaaacataaagataaaagtctgaatttattcataacaaataggcctaaatgggcctagaaacatctaaaaccgcgttacgtgtaaaaaggaaaaaatccaaataaagaaaacttaaaaatgacaaccaaaagaaaaatccaacttggacgctggcttcgtctctaagtcagccccaacctctatatatatatagaatcaagaacacaagaaatatagaacaacaacaacaacaacaagaagaacacacgaataagaagaaaaagaagaagaagaagaagaagagaagctt

SEQ ID NO: 4800 - DNA, 421 bp, Arabidopsis thaliana
taacctgtgatcaaatcgtttaaattcaatagaatcctcttaaagagtttaaagctcatctccgtcaatcaaaacgtgaaattcgtaggtttcgaaacgtacccattcgtagccataaaggaatttactctccaggatacggaagttttgttctttgttacgacggagtcaaaagtttaaatctttcacttttgtctgaaaatttccggccggtgagagtgattggggatgtagggtttagcttatcccttttcatcaaaccggaaatctctaaccaaactaatagattcaatgaaaccgtaattttaatgaaaataataaaccggaagccttgaaccgatttgataagctaatggacctcacagtctcactcttaacctgaagaacgaagaaccgtctctaaaactccgacgaacgaaaa

SEQ ID NO: 4801 - DNA, 1162 bp, Arabidopsis thaliana
agagatttagtaaaccgaagctgaaccatacacagaggagattttcaaagacaaattgttgctttttgtgtttgtttcagtttttagactaaaatcggaaaagagagaaaacgttttgagctgttgcggaaatggaaaataaatttctatacatttaattgatcattgattaaatcattacatcatggtttataacgtgttaaggttgcgaattttgattggttaaaccgaatgaatactaatccaaagtccaaacacacagacaaatccaaaacctgttattctttctatatcaaacaagaaccatagaaagaataactgaccaatattttatttatttatcgttttttgaatgagaaaactcaaattcaaattcagacgaagccaaaacatatacccggataatgaaaccggaaccgggttagacccacgtgaagatttaaatgctagactgttgttgcgtggctttttgatagacaataaataatttaattagtaacgcgtttaggtgtaatttgataatgaaactaaacaaggtattccaaattcacgtgcggtggtggggaggccatcaaagatcaccatgtggaattgtctaatttggtattttacttgaaactaattaattactccttaagatagtgaaaacggcacgcaactcttttctgtatttagaaaacgaaccgacgttttagaaactaccaggaagctgctgttgtctaaattatcatcaagttggattagttatttatttggtttgtcttttttttcttacattagtcaacgtttttctttattggatttatgactgttcgaagaggattaaacacgtcttctcagtttccttattatgaaatatctctcagcgtttctattgtaacttttcctttcttagttatatgaggaaaggaaaatcaataacttgcaataagaatcgttagcaaacacttatcgaacgtagatgactattacaaaagaggaaacacttaccgaattgtattaaaaaagggaaacttaattgcactacacaattccagaagaactaagaacaatagacatcctctatatatttagattttagagtcattgatagagctcacacaaaatattgaattatattgactctcatataacaactatcgcaagaagtagaagaaagaag

SEQ ID NO: 4802 - DNA, 2000 bp, Arabidopsis thaliana
gctgcaccactaggatgtatgtgtgccaatagatgtcacatgatttttcaagacgagtatcatcgttgaagaaatttttggaaaaagttttgaatataccaatggttactacgatgattatttttaagaaaatcaatgaataaatttgttaagtatgttgttttgttcacattaatctctctgtattaggataaattattatttacacaccgttgtccagtggcggagctaactcataaccaagggggtcagttgaccccataacattttaaaattcttatttacatgcttatttaattggtatataatggtatattttggcttgattcatctcagctgacccctatgactcatgttaaactaatatttgaccaccataataaacttttctggctccgccactgccgttgtttatggacaaaattaaaacgtgaagttgaaattatgaattcgtaacattcatttttttaacatctacgtatattactttcaaacaaaagatacaaacataatacaaaccatcaaaacacaaaataataacaaagaatgataaaatagtaaaagttatgcttacgtgtgaaaaattttactcgctaaagaattaagaaatccattactttccttcgtaattgggcaatgggctgcaccatgttttcagttgttggacatctgaaccaatcttgtgatataacttcgaagtcccaaggtccaagtatttacaacttaaattagtagatctctatacactcaagtctcaagatgttctctacactataattaaggacttgcattagaattttgttcgttcgagttgtaatcaagctgttgatcggcttgctaagagggttttttcctcttctctaattgttttagaaatataaatacttctagattggttgacgatataaaatatatctttgataagaaaataaaaatagtaaatgtccgatagaaaaaatttgaaaaagtaagttagtaaaatgtccacatcaatatacatgatagtcatcgaaacttaaaaactacaaaaaatttggactatataataagaaatgcccggtaatctcaaatgatatttatccttttttttcaacaacaaacttatatttatactatttaacgaaaataataaaattgacatcgatatttcatcatttatctctctaatatagtacaattacttaaattagtgtgcaccacgcatgatcgttatttcgtgcacgaatgaaatacttgatatagttgtggttatatatgttttattaaattataaggaagcaacatagtcagactgtaagacttgtgaaattacatgtggatacaaaattgattaaagaaagacaaaatcttgaggaaattctccatcagctcgatcgtgaattgaagatcttcaaacttgttctttcaatgttttgcttctcttatccaattgaaactccaaaattaagtgtgataccatttaccaaatctgacactttagttctttagttcgtaatctcaaatctacttcagctcgtaatcccactcaatcttgatttgtaatctcaatcaaaattaacaaaagttttgttatcttttttttttttgatcaaaattagttttcttatcatgcatttaaaatatgaattttttaagctatttcagtatttctcttagttacaacttaataaggttgtatctaaaattaatattgatttgttttatagtatttaactatagtaaaacagcaaagtcacttgtagtgtctcctaattctacaccccaatctagaaataagacttatgcgcaagttagcgcaagccatcaaacatagtcaagccgccccaacctattaaaatgattaaagcatattaacattcatcatctagataacttcaaaaatgcaaatactaattaaaaaataaaataatcaaactaatacgtaaccatttacctctatataaaatccatagtaatattatcaatagatcacacatacataaaagtagtagaactaaaaa

SEQ ID NO: 4803 - DNA, 873 bp, Arabidopsis thaliana
ctctcgtttccgaatccaatttacggtttactgttaaaaaaccggagtgttacggtttaggcccagtaaggtttaggcccatcaagtagaaacccaagtcaatgacagaagcttttattagtgaagtctttctaactgtattgttttctcattcaccatctcatgttatcgtcaaagggaatgtgattgcaagaagttattaccagaatcatacactgaatataagaatcaatgaagctaagtcctaattcctaacaaattattgttgttgaaagagaaaaaaacaatagaagataactcaaagaagtatgtagagagaaagagtgagaaaagggaagaagaatgacgaatgcaatgacgtgagattcaactcctaccaaaattcctatcaactgtttttgttgtaattagacatgtcattgtcattgctgacaaaataaggaagacaaaacaaatccgacttggagataagcccgtttagatttattcaactcctatcataaggatatcaaatttttcccatatcatcaactttagaaagtttctcaaatatctgcaacgattgatctctttacttctttaaaaaacattaggttatgggtccgttttgtgattgtaaaagcgacacgtgattgattagcaacatttaaatccatatcttgttgaacaaaacggtgcagtttcggactttcgttaccatatattgtagttgttttgttatactgtatatataaagcaagcgttatctcccaaacttcactctcttaccttgcctcttgcttcaacctcctaagcacattcttatctctttctgaaacgagttcccaaattagctctacaaaaaccaggatcttgatttctcatcagttaaac

SEQ ID NO: 4804 - DNA, 822 bp, Arabidopsis thaliana
aagaggtaaacggaaaaaaagagaaaacaaatccaattagaaggaagctcttacgaggttatatattatattgaaggaacataatatattcttcaatgggggctttttgtctcttcatcttcttctttttttttttttttttttcttcccattttggtaagtgaattgttctctttagattagaatcgagtgggtgtactatactactactacctgtaatctttttccctatctttttttggtcgtatttacttcacttcacttagatcattgaatatggtgtcatctaggagcaattggatcatttaattattgtcatgtgttgggccttgggagtcgttaactctcgttcatggtgttaatttggtttcacggggtgagtttattgggttatatacggtgaagtccttctaagaaaattctgactcaagtctgttgggaaattacatgcattggctcaatctgaaaatttagtgggacctgcaagcaataaaattgcacaaaacaatttgaagcatatcagcaattctttttcataaatagcaatttagaacccaaataagcctagaatcttcctagtcccatattctgatggagacttgtcccaagtccaaaccacatattactctcaccaacgaaagagggcacaatgtaaaacaaagacatagagacaatcaccaagaagataacacaagagcccacacatcgtacgccacgtggcagattcacctctttataatcctctctccctcacggtttctacgacattttcacaaagccacaccaactcactcacaaaatctgtagaatcatctttcaaca

SEQ ID NO: 4805 - DNA, 2000 bp, Arabidopsis thaliana
acaaattttctatatcaaacataatatacaaccatagagccattagtcaagcaacttaccaaagtatttgactcgtgaatacaaagaagaaattaagagtcttacgctatgtagacgttacgtacatgttaatctgttaggcaccgattttaaaccatatcagattacagcacacatcagccattagattctacataatctcaattcaattatatgtttaataaacaattacctgaagttttgagaattcggtttctctatatatagaaacaccattcttaggtatacttttctagattaatgttcgtaaacaacataacgaagcatgtccaaaacaaaacactaattagcaaaacaaaaatgctaacccatcatcaaatggctattttcacgattagtaagtttcagttacgttctagacactaaacaatatgaataatattttaatatgacaattatctaattaggctggtgagcttatctagagtttcacgttgaatgtgtttaaatacaaatctagaaaaaaagaaagaaagaagctgaaatatccaaaaatatgcgttcacacccaacaaaatgttcaaatctactcaatttaatttacatggatgatgagaaaagcaattcaaaaaaaaaaaaaaaaatcagttcaaaataaacaacgtgaaggcaccaaactagtagaaataaaataaagatcaacaatccgtacacgtgtcaacctatcaagtttggagtccagctgtctggtccccccaatatacacacacctctaaaaacttattctcgcggagatgacactgatttggccaaaataccgcgagaagttaccaatgaacgccgtttttaagagatggttttcaattttttttgtttagcttaggctattaaaaaggtttaaagttggttgccggtgatttgtgggacaacccgtacgtgattactgcggattaaccggatattgccggtttggtagtgctggtcaaccggattataccccgttataaaatccgtgcccctatcgatcgcattccctgttgttatggacggacacaccccttatttaattatcgtattaagtctgattgagatagttaattacttatattctccatgatttagattactgtttcgaataatttagattatgtagtatggaggaatgatttgcgtattttacactgagtattgcatcaaacattattgtggaattcaaattttaaaccctatgtatttaacttaattaaacattaaatcattatgaaaccaatatatatatattttagtaatatatataagttaattactccttatcatctgacgaccaaatgtctcgaatataatctgttgtcatactcgtaccaactacactgcaattataatggatacttgatgaataataacaattcaacaagtgagatttttttcatttgtaaatgcaaacaaagtaacaaactggtggttcattacaaaatcttcacaattatatatatgcttaagtcagctcaattatatgctaagtctaaaatcttcatagcaattatagtcacatggaattctctattaaagtataagaagaaagaaatggtatgaatgaagaatgatatagttagagaagtcattattattagagtagaccatctttatccatccggtacaggttttgaccaatacggaaagagagaaaaagagtcgcaatccttttttttttgttacgaaattaaaattatataattagtgcaatttaaagcacgaatagtaagcgttcacttaattcctcgattaactgattagcatattacgattatacccttcatcttccttattgtgtctctactctctactttcaccttcctttccttccattctcctctatatatatcgaccctttctctttctttcttcctcacacactaaaagcttgcaaaaaccataagcttatctacttactcatctctctcacaaatcattttctcagacttctctctttctcttaaacc

SEQ ID NO: 4806 - DNA, 590 bp, Arabidopsis thaliana
gtcacatagtcaagtatatgtatgtttctacaattttagatacttggaatatggaattggccgttcaactctcagaaaagatttttcatcaaacatgaatagtcgaaagcaaaaactttgtccttgtaacattatggtttaatagatttacgtttcttaaaagttactgaaccatcaaccatggttttggttcaatatcaattacctagtctagtcttaaattgtctatagtttgagggatccaagacaaatcgtttcttattttgtaccagcgaggccagacacagtttcagaaaaaaaaaaaaaaaaaggatgtgtatacaagagtgaattacatttttatatagtatatagtatagatctgacaaaacggagagtacgtagtaattaaaactacaaaagcgaaagataagagaagagaaagcaatgcaataaatgaaaccaaccaccaactaacctcacaccttctactttcatgcatttgcactcataagctctctctatataaacccaaccttcattaccattcttcattatccaatccaatccattacttactaagtaaaaagagaaaaaaaaaaaattaagat

SEQ ID NO: 4807 - DNA, 2000 bp, Arabidopsis thaliana
gcatattgataactcgtcgtacctagaaaaagtcaaatgttatacaatgatatgaactgaaaaatcacattaagttataattggtatttttcattgattgaagcattaatatcgtgtgtgtgctactagcagaattagggggtaaaacagaatttcgttaagaaaatgcattaattaaaaaataagaaagatatatatatatatacatatatatatataagagtagattataaatgaaaaaataattaaggattaaaaataatgataataataatatgtataagatgggtaacctaactttacttggacggtcgacaaaaaaaaaaaaaaactttacttggacgagtatagccgacaaattcattattgggaagtgccaaaacaaataacaaagctgagaccaaacctaatgaaacgttacacataaactttcttaatccattactccaaagattttaggttattgttgacgaatcgtattcacccatatcatttttttagtttctacccacttttattgtacttctcctttgtgtgttctcttgataattctaatgttacgtcaggtaaccaaacaaaaagtgatttaaaaggtgagcacccattttttacaactgtttcgaccacatattgcaatttgaataaaaatcgggtaaaataaacctaactacggacttaagacttttgattatatctagcgatatagcttgaccgagtcttaatttgtgatgtaatgactgctcaaaatataatagtttgaattccggcttttaacaccatgcatggtataaatcagtaacatttgttatcatggtatagtgacatttatatatatagttgttcttattttagtattttaccctaatatataaatatattcgtacactttagtttcaaaatgattttacttccttttttctcttatatgttttattggtacatcagtttatcttgaaagagaaagcgcgatatgatatattataaaactctaggaaatactttgtaatctatatagataactgtgagttaaagctcgagactaattatggatgtaacgagttattggtacggatgaatcaccttgtttaaaaaatttcgaaaataaagtatatgcctaagcctaactctttccaaaaagtactaaattaattggtgaatgacatcaagagaaccaaacctaaacaagatggtggggatcactatccatatgtatacgaagaaaaaaaaataactaaaatatataatacataattaaataaatgaataaaacatcaagggccaatgtgtttctatgataaggaaaaggaggctgaaaattagtgggtaaaagtaaaactgtcttgtggtccgttatttaaaggcacctcttaatcactttctaattactattcatactaatttcgtctcttttttttttttttgtctacaataacgtacgcttcatgataaaaatattcatgatataaaaatctaaaataccgatgccgactgaacccaatgataccagaaaaagaatggagaaagctttaaatataatatttaatttatattcatgatacgataattccatcttctaccaaatataaaatcattgaactttttcgggaacttttctcttattagtgggaagaatagtagcaagtgccaagtgagatgctcatttggtcaacctttgcaagtaagaaaaataaaagtagagagaattgtgccatcataatttcccacattattttttttttctttcaggaaaagaattaccaagaaaataaaatcatttctttaaaataatataaatcattcctttgattaataactattagccatccacccacccatcaatttcttaaaaatataaaataaaaaaaatacttttcttctccttcttaagaagccccattggcttcatctcctcccattatcttctaaactcatttccttttcctctcgaaatctcaaagatagataaattttaaaggcatatttttttcatttcgactcag

SEQ ID NO: 4808 - DNA, 2000 bp, Arabidopsis thaliana
cattccaaaaacaataatttatataataataacaaatcttctatttaaaccattttgcaatgattggattgagattcggtggctggctgtcactttatcgcagttatcgatctttttgtctaccaaatgatatttcaaagagtcaattagtagtatggacaaatatagtaataaaaatcaattatgattctgtggctactatatatggagtttatcaggccacagactgagacggaagaatgaggattatgatgttccaagagtagtggaaattttttagtaccaccaaccaacatttcgtcttaggacgagaattaaacacttgtagactttataataacatttcgtccaaaatagtgggcactaaaacaaatttattattttctttaaaaaaaacacgcttttcattataatcgagttcaaattttcaaaaactctagaagtactctatttacgatataaacccatttgaagtcaaggctaagttcacattcataaaatcatgactcatgagcgacgagatcaataataaacaaattttcagcctacatttctgatttcttgcacgttatatatagcttgaattgttgtgccagttaggtgattttaattaggttaacttctctacttaatttggatatttgcatgtggtgtctaccacgttacgtggttttagggttattatttatattttactaaagtttatatataaagttcgggctttaggaatcaagcgatcaagtcaaaaaaattgttggataaattttttaacgtatgttttgttttaaccaacttagaaactttgtatttctcgtggcagtttttttcccttttcagttctcgtgccaagcttaagaatatgaaaatatactaattgtgatggtgattcaaacccttaacaaaaaaaaaaaaaggtgatggtgattcatcacaaccatatcatcgggatgtcacattcaatactaaaggacgagacctccaccgaaacaaacatctataaatccaattttagttaatgtttttttttgtttgtttctgaacagttcaatagcctataagtagttatatacaaaagtaataatgcaaggaaacttggatctatcttaactttgattgatacaacagaattgacatattcaaaaaaatatggatgtcatattcaatttttattatttttgggaaataaaatacaatatggatgtcacagtgataatatattaatatgccagcaaacatgtaaaccatcatctattcatctacgtttcctctaagaagaaataaattggattcgaacagatttagaactctcaacgtcatcagaaattagtatatcaaagagagtggatttccaacgacatcattattttccaccatataatttaaacctcattaataaggtttcatttgccgtttaaaggcataatcatttgccgttttcctctataattctcttaaagttataatttaaaaccccaataaattagtaaatttgacaatgacataaccaaaatcctaattaattataaattttgatcaaaaatctattaaattttcaaattcgaagtctactcacctatttttaatcttactctaataaataaacttatctatctctatatatccatactatgtaatcgttgacttaaaaaggtataatattatacaatcgttgacattaaaaaccatataatatacaatgattgagaaactgcttatccactcaaccaatcaaaacaaagtgtaatcggaacacgtggattttgaaccacaagacttggtttatgcttgtgtcacatttatgatttcaacgaagataatatccacaaatctagtaacttctgtatgcgactctacaaccacttgatttgaagagttaacgtctcaatcacgtcgtcaatccctgtcactctatctctatcttataaagaagaagactcttcgaagttctaaactcatagaaacagagccaacaaaacaaaaacagaggaagaaaaacaaaa

SEQ ID NO: 4809 - DNA, 485 bp, Arabidopsis thaliana
acaagtcagaaaagaaaagaaaagcatcacttgaatatagttcagtaaaaaagttggttctttcacgcctttaaggcttgcttatcaaattcatttgaccttgtttcttagtagtatttgtatcttttggctttgagaaaagttgtatacataaattctggaatcataccgttagctctcaaaatgtatacaagatgagttttgttttgttcttatgaaagcaaataaagttataaagtcactttcgtctgaaactaggataaatgctagaccttaaaccaatttaaaatagttgggataaatgatagaccttaaaccaatttaaaatgttgggataaatataaattctcgtaattatctgatgttatatttattcagaaacaacttgagatttggtttccaagctattacaaattctcagatatttcagtcaattagggttttgttgccaaaagctatcaaaagaatcaatcgttctatttgca

SEQ ID NO: 4810 - DNA, 1222 bp, Arabidopsis thaliana
tcgacaagaatcttgttttgtgatgctgccgaggatcattttcttgtattaagaatcttgtattatatatcactgtaacttctacatccatcagtggagaatcttacattcttagttttttttggcaacatacatgatctatacatgtcttttggccaaatcttatttttatatttttaatacatgatctataacatgtattaagtttgaaaacataacaaaatttttgtaacaaaaataaccaaaatattatttgaaaaagaaatatccaaagttttaatagtaataatacaaaaatagaagtttgaaaacattttttaataaataaaaaagtgttaaaaatttatcacaacgctaacaaacaaattcacctaaccgtttacttttagaatcagaaataaacaacaaaaataaactttcagaaagttgcagtttcacatatgttacaaacatcatcagattctttgaaacaaaacagtaaccaagaagtttcttatgcatagctttgttcaaaatcaatactttggagttagtcaattaaattcatatgcaaatctctgaccttttgcttttgtaagctaaatgcattgaaaaaagggagaggctctggatcagtgtgctcatggtgggccggcccatcactatgggctgtctaaaacaaaaacaattttggaaggcaaaaggtataataaccccgtccctgtatgttgggctaggcctgtccagtatccaccaccactaactcaattcccccattattacaaatttacaatctctccaccaattggccaacaatggagtatatattaactataaagcaaatcataaagcttctatagtaacatcaagctatgaatatttttatacgttctgcaagaaacgtgacatcaacattttgtgattaaaccgattcttaatttgtccctttctatcatcaagttaaaaacgtgacatcaacactttgattaagagaatcaagaaacgtgacgtcaatattttgatgaagcttgtgaaatgtggacagctattttatcctcgatgatattcagattgttttaataaaaatcatttcagctatttttagtcaatatagacggttttgccaaactcaaaagtcaaaagtcaaaggtcaaaggagtccattatataaaccatagcttaatcatttgattactaaacactagtataaaaaattgaacccgttaaccggcgacccgaaaca

SEQ ID NO: 4811 - DNA, 471 bp, Arabidopsis thaliana
aatcatctgtttttaggatttgaaattgaatcatgggagattacttactatgatcccaataattgttttcctttctgtgtaatgttgtacaacttttcgtctactatcttcaaatgactgctttcttccttcttctttttttctcgaaatcgcggtgttgaaggatatatcacagttatatgcgaaaccagacgttatgaagactatataatatcctgatgaaaactatatgacatgaaaagaaggattaaaaaaatgagtctcttgagaaacttgtgatcactggctcacagaatcttatccccatatgtatcttacctacataatagccacatattactttgcttcactttgaaccattggttggttttgatcaaaaccaaaggatgtgtgtatgtatgtatatattctaacgctcaaaactgatcactagcattcctagatttttccttcttgtgatcacttgcagct

SEQ ID NO: 4812 - DNA, 2000 bp, Arabidopsis thaliana
acgaaatgtaggtgtacatttgtttgggctgtatatatttctattgacattaaatacgccaaattagaaaagaaaatctttagttggaagcatctattatatgtacctctttcggaatgtaaaatcacgtttaatatttctgaactggtaatcaatctcatctcctaaaatttaatacatatcatcattgtcaaacaatcggagtagcgacgagaactatcattgtttttctcttgtgatattgccggccaaatattattacctcaatcattttgaagcgagtaaacatagtttttttcccccttttttttgttcttgtacaccaacagaaagctgcatcacatctgcgaatcatcacgtgccattcaagtgattactggaacgtgacatgaacgaatcttcacattgagtgttccaactctcctttgtacgaaactccaaacaagtagatatatattcaattattatggatgttggaacaatcaaattaactcttgtccttcttatcgtagagacatgaaattaacccaattctgtaaatgagtagtaagtaatctatatatatatagttgacaacagataacactataatatatgcgtccttataatgttaatgtaattatcatggtttgagttaacgtatagaagcattgaaacttagttgcagaccgaaaatgatatacgatcttaagagttaagaatcttgaactcggcaaattttatgaaaaaaaaacaatttcaaccatttctaactagtgattagatgaccaatagcaagcatgcaccaacgacttcatttttataaacatcatagggacctagacatatgcattttgtgggcaacggcctacgcattaaatttgtgtttcgaagattaaatttatgaacagaaggcaacttgcaaatttgctatgtacaaaaaacacaaaggaaaagtttgtaaatagagacaataagggagaaataaaaagatcgctttctcataagtccgacttggttccacggtatctagaatgcccacgtgatgtcatgtacttttccttcttctctattctaatatgttgtttaacaaaaagaaaattgattgataaaaaaaattgaaaaatttcatagtgatatctaaagtttaaacaaattatctctaagaaaattgttagtatgccttggaatataatttctcaacacacaaactgaagaaattgcttttaaaactgaaatttatatggtaatggcatactaataaacagctaaacttttgtagttttatgtgtgtgtattaagagatttttcaaagtgaatgcaccttaaggtcatgttttgtgaggtttgatgttggagagagtctttgatccgctgaagaattggccaggtatcaaaatcatttcttaatttatatataaaatttcaactttaaaaaagaaacgttcaatctgagtctcttaaaataacaatgtgaatgttaacactttgtagatatcagactatcatagataagattgctacttaaaacattgaaatgttttgatgattcgttaagcctagcaatatatcatgtcgttattgggcttgtttacttacccagttacccgtattccagttataagcccattaatcagcctcgtacagttctattgttggtcagattattaatttttaaaataagggcgtattttccgaaactaaagaaagtatagggtcttcttcttttctctaattaggaaaaagactttttcaattgtcttgtccgtgaaattatgtggagagctaaaccattcatagcccgacatgtaacccagccacgtaattagaccactcgatcaccgttcgtattaatgtgattaaatcaacgattgatatcacgccacgtcattgtttttcttttttcctttgtatcttctgttctaagggaagaaataataacgagagaagaacgttttaataaacagagagcagagcacttgttctaaagatcaaagcttaagtgagaagcagaaaaaaaa

SEQ ID NO: 4813 - DNA, 2000 bp, Arabidopsis thaliana
atactaactaaaaataaatcatcatgcagtatattacgaattaaaatctagtttcaaaagtaaggaaacatctacgtaacataaataatagaactgtaagcacaacaagcacctagatgtcatttagtagacaaggtttatgatatctaggtgctcttgtttatagaagaaaaaaaaaagcacctagatgtcacaaaccttgtctactaaatgatgtatcgcccaacaacttcgttatgaacagatccttcggccactcttgtgtttcatgatctcctacgaaatctaaaatttacaagaccattctgaagacgaaatagtattagcacctacgcaatagtaaagaatacaaatcaataagacaatttctaagaatgattacaaaataaaagaatgtttatattataaacaacttaataaagaagaaaacgttaaccatactattagaaagaaatagtaaagaaaacaaattaaaactagccaaacaaaatctacctttttttatggatcaccatataacaagaaccactaattatatatttcaagttataaatctttacttgatatagaaattttaaccatcaagaaaacaaaacgtatttgctttgtaaaagtatcacaacaatgtcttcatcacaattttttatactttgcatcatcctcatttcttcatttcctcttcatgaatgtatgcctatatattgttttctttttgatcatcatcaccttaacataatcatatctttcataatcggtattctcaaatgatcgtgttacttctttttatataggtgaaaatggaaaaagtgttgaagcgagcaatgcagctaaaacactttgcatgtcagtgaattgcgataataaagacagaaatctcacttgtgcttgttgtttggccaaatccaagaataggtgttatagtagcaaatcagaatgtgttgctgactgcaaagattgaaaggcataacttaataacaagctccactaaggaattaagaaacttgattagcgtttatataatactactctctctagttatggtttccataatatgaataatacaggcttatttaaagtccatgactaatacagtttattcttattgtaattgtattaagtgaatttcaaattatacttgttttatttttttctttttcgttttcattttgttatactagtcatttgttctagaatatgttgcggtcaacgagttttcaagaaataaagaaagaaatctgactacaaaagtcaaaggctactcaaatcgtcattttttattcgttacgattctgataacatatatgctagtaatacaagacctttagaaatgtcgttttaacatttaatttgcatagggaaaaaaaaataaaaatagacctttagaaatgtgaatagtatagtttttttcaaaaataattctcaattattacatacagtaggagatagttaagacaccctcagtgaggttcaccagttgtgtatgctcttcggctaggctaactaaaaagtacacatttcttactgggcttgtgaacaatttttttgtatggctcataaatttattttgtttgggcttgtagtaagttacccgatggaaaaatgctacacatcatacatgtggtggttgcaaaaaaaataatgttaaaagagtattttgtcacctaatttagcgttaacgtttttgttcttatcgctaattacataattaacaaattaacattgacttataattccagattatcacaaatcacaagcatgactcaaaacaacaacacttgacttcacaactggtttttccctcgcacgagaattgaagaaaatagtaagaattctttacttctccgtcgcttactcaatcaaagtttcttcaaatttgcatatctgattttgcttgcgtctgtttccggcaactcgttatacgtttcttctccgatttgggttctcttattcaaattgattaaacgtgatttcagagaagaagaaacactaaacaaaaaagt

SEQ ID NO: 4814 - DNA, 2000 bp, Arabidopsis thaliana
actctttgtaatcgcttatacggttaaaggtcgaatgtctgaacttgaagtaaaccaaggaatgataatttaatgagtttagatcattttccttgtctctcatatcatgaatctgattggttaagatagtagtgcttatcagtataaagagttctttgagaacttctgaacaaacgcaagaccttttaaaaaccgtttagagggtttctgcaacttaacttctaaaaccatttgagtttcaacaatatccattggtgttaccgaatctgagtttttttttgtttctactgtttgtgttatgttttgttattacaaagcattatgcctttgttagctactgaaaaccattctagatgaatctctgtatgggatctttagcttaatgcccggacttgctaaccgaattagttataaacttactgagttactgttagctatttatcgtcctgttgatagaaggtcttgaaatttatattcttttatttggctttgcaggaagcagcagataacaattgtgtttacagaaacgaggttcatcactctgtaagtgaacaaactcagatcctatctgacgttgcttccgacccaactcttccacgtaccaaggctgtgcgatgcgccaagtgtcaacacggtgaagctgtcttcttccaggtgaatcattatcttatatcttaatctttaattcgtcatcaatcaaggagtaaagaaacattctttcgtttttctctgatctaacttaaagatcaaaagagatttctttctcttgctttttaatgtgcttatggctatttcggtttgatatagctcgtgtgtgtcatcgaattttcaggccacggctagaggcgaagaaggaatgactctgtttttcgtttgctgcaacccgaactgtagtcaccgttggagagaatagattgatagaagactacatttttcaaatgtaacgtgtatttgtgttccgctttatgagttttatacaattcaatttggagttttctgtgtaaaaatatgaatactatgagactgttctcgggtttcttgaattgtttcagggtcttttatgatcattttggtttttatgtgggtctaattataaatttgtcgttttatgcggggccgatctgaaaattcgtccataaaccatgatagtgttgaaaatttgtatacgtggagtctagccgccggctgctataactttgctataacgtgtgatattataaaaagttgataaatctaatcttctaaaccaaattgttttaataatgctgtgtttacttcgtcatcgtatcgaattatacggctgctcttgttaagtgatgacaatatcttcaaataaagttttttcttttgtaagcaaatatgataaaactacgttagctaatagccaacttggtccatcatagttcataaagtcaaaaaatcagtaaccaattcatgagtggaattatacttgattcaatgacactgtttaggagcttatctaaattgcacaagttttgttacacgtaaaacacaaatatgccaaattagacatgtttctcgtcattctaaaacattaacaaatatttacatagacgcagtcaaataaatcaaatttcgtatgataaaaaaaaaacaaaaaaaatagcaaggttgatttgtcaatgctggcaaaaataagcaatgtcctaatttctcaagttggaaagtgacatttctctacccattttttgaaaagatattctcttttgcatataagatttgataaattgaacgcatatttgcactcaagctaacgttatgtacttgattacttgacccgactaatgacttattgactttgattaataaacaaagatattagccactccattctacattatatacaatctatacgcatctatatatatctactaaaaaaattgtaagtacatacatatcaatgttaatttgtatataaggagctaagaacaaacccaattaggcaactagcaattgctaaaacacgtaagatctcaaat

SEQ ID NO: 4815 - DNA, 2000 bp, Arabidopsis thaliana
ggaatgaaaggagacaatatcataattaagcatattttcacatctgtatatcttatatataaaacatcattcttattaatatatttaccgttgaatcgaaaaataggaatacgaggattttgaataattaactgcagcggaagaaatacggtggaatgaggaagtgttatgcacaaaaatgttatattatgatggttaagtaatttaggaaattcttataactaaagtgtaattattaatatttagaggccaatcatatttagttatatgtacgtatatcatggatgacagtttgttaccgatctcatattgcattaatctagctatcaaattaaagtggaatgctttttcttgatcaacaatatatacatatccatagtatgtgtgtaagcatatattgataaagtcgtataaagatgcatacccatgtatgtattgtgtactaatatataaagagtatttgcagtttgggtagctgaagagtcatgaagaaatgaaaaacgaacaaggaatatttttataaaataaatttatgaatgccgtatatcactgaaaacatgatcatgaaaatggtaactgagaaaatagctgaatgtgtaagaaaaacaaaaaaaaaagacaggacgaagctacgtggggacttgtgtaaacaacatgataagttaatataactaaattagtgcggcgataagcaattccatgcacctggtctgttttctttttctccgtaaggtgacatgaaatcgatattcaccaaattttggttgtatactagtatatttttttttcataaatagcaatagtaaaacaaagttactaaccatataaatgtgatttttaaagagtaattttgctgtaacagtcacgcaatacgtataatttgaaattaatattgtgtgcaaagacgtcaaggtgcattaaaataagaaacaaatactaaaagataggaatgacgtgaatttgattttaatgaattttttaatgacatggtgatacagtgacagggctgtgcaaaataggaagtaacaggatgaggaggaccgttagatgaatgaggatcaagcgtagatccgacactgacccgaccgtcgagtatgcaaccctatttaacacactctggccgaaccaccacagctgaataaaactattttttttaataataataaataactttagagaaaaggtataattcaaatccaacggatgagatctgtttccaagtccactcgctaaagaaagtggaccccagagagctcagaaaagtccacttccgatttgtaaacaagccaatcactttcgatttaccacaattgccccttttcaagatttcgttgaaaaacttttgttagtttttaagtagtacttattatataagaaaataagtaaattcaaccatcatgtcatttttaaaatttttaagcaaagtacgatttcttacatatttgatagaaatttgtagcctagttattctcgatagtatttgctcttctgtgacacactacacaaatatttaatccagttgattgcaaagtgtgagatgtaggaaaaaaaagagagggtataagagtcatttaacgaggattgctggttggtataaaagacggcgcttgttgaaggaaatgagtttagctgagacgctcacattgcaaaaacaaaaccaacaaggaacttgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaa

SEQ ID NO: 4816 - DNA, 1829 bp, Arabidopsis thaliana
ctctcactctccatctaaaaggtgcaatcttataagaatggtttgaacatggatgttatagatttaaaagtttcatgtcctatgatcactaaccaatatcttcgtttctgtatcccgtagatgaattctttgtggattcgattccaggacctccatgttctcagtcagaagaagacaagtcttaatcaagcttatgatatttgatcaatagaaacagtcttattatctagcaagcaagcattgtttgtgccgtttctctatattagagaaaacctcccaaaaggatttaaaatcttcttcttttttcctcttctaagggtaatgatcgatcatagattcatagacttagattaattgctcagttgtttgtttattgtacacctttattttgggactttgctaagcattgtataatatctcccaataatctattttcttgttggatagttcatcaatatgcatgggaatatctcatttttttccttctaataaatactccctattatagaaatctataaaagtgttcataattataactcgtggaaattaatttgagctttaaggaatgattgatatctttttgtgaaacaaaaaatcacaaaaagaaaatcattgatttttttttttttggttggaaaatgattgattcttttgtttttttgggtaggaaaatgattgattatttttgtagaggagaaaatgacgtactctaaaattcagaaaaaagaaatgacgtacgccaaaaaaagtatgaaagtctcttcaagactaaccactaaacaccaaacaagatataattttcttttttttttttgtatgtggagtagaaaaatcattgatttcgtatataggtagactaatcaacgtttgtggattcagaatttcaaatacaagtgtccgtgaattaaatccaagaccgtgaatgcataaaaaaaactaggtctataaagtgaaaaaaaatacaaatattaagggagtaactgagtcatcataactatgaaaaatatgattgtttgttatacataaaaaaattatgaccatacatatatattttctttttaaaaataatgaacatattgaggtaaataaataaacaacagattaaaatattatatatcatggtaagaaccacaacatatatatataagttgaattagtaaattaaaaatgttggatggaatttgctcattcactagaaaaattattttcatatttcgtctcaagaaaaaccaaattggaattgtaatttttttgggttgactgactcagtcttcgtcaaaagtcaactcaactttattccctttccaaaatttattattattgaaaacttgtctttttcatgtgtgttccaggctcgtttcttcttcacttagtttcaattcaaagttgtactaaatcactacttcgccaaaattagaacatcattatcttcgagggtctcttctctcttcatactacttcaagaaataattaaacctttttttcccttttaatctttcctgtcgggaagacttttaagtaccatttcttttccgggaaacaaattctcgaataatcacagaaaaataccttggttcactttttttactgtatagatcgtccattgaaatcaaggttttattctttaaaactttggtctttatttcacaacttctttgaacttcaaatagtttaaaatttactctgtttcatcaaattactctgtttcgtcaaattactctgttttgtcagcttgctcttttctaaaacgtggaagtaaataaaattttgacataagtatattttctcccacaggttcaagaatctgtggaagaaaacaatcagcgatg

SEQ ID NO: 4817 - DNA, 2000 bp, Arabidopsis thaliana
tatatgttcttttctagaacacattttttaattgaaatacaaataaactagatatagaaaaataaattggaggttataagtggcaatttagtcttttctaataccattatctttcaccactcccctcaatatacatttctcctaaaaaccctaaattccaaaaacaaaagaaagaaaaacaaaactttcttcttcttcttcttcaccatcgaaaagagataatgaaccaagaagaagaaaaaacagagaacaaaaggatcaacgagatcgatgaagacgaagaagaagagttggagaacaagaagatggacatgttcttcaatctcattaaaaactaccaggatgctaagaaacgaagacgacaatacttaactcaagattctggcgacgttgcttcgatgccgaccaagagatccgactacagcattgttcctgtattccgtgctgaagatttttctcactgtatggacttaaacctaaagccatcgaattcgattatctccaccaagaaccaagaagaagagaagcaagaagaagaagaagaagaagatgatgaagaagaagaagatgatgatgaaggagaagaagaagttgagaaggtgatgagaaaagataatggtttagatcttaatcttgcattgtaataatacactttgttttttggttctgtttcgtgaataagaagaaaaaaactttcttaattacattattaaaagagtgacattgcaattaaacttaaagcagtgaatcatcaagtcaagaagctgcatgtgaaatttccattgatgaatgttagcttctcagctttgacgacagaatctagaggaagaggaacgaaggttttgtctggaccatagaagtgagggaagctatttacttcatccacagcttcatagattaatccatctccaagctgccaaataaagcacatcaaacaaaaacaaaaatgtcaatctcttcttagcactaaaatgtatccaaaacatcaacgtagcataacgattcaaatgacaattttgtaagaactttacatcaatgtccatgaccatcctaagatcatggttctgctacttagattgtgtttatccacaattgcagcttggtaagaaaaatgtttgaaacccattttgttttcaagtgtacaaaataacactaaactttagcacaaaccacacataaccaactctagctaactcatacccactttagctaactgctcctctacttaaacatggagctaatcacgcaataaactaacatttaccaaatcaaccactcaccaaactagaggatccctaacacaaaaatgatcataaattttctatccacatatgtttcaagttaaaggtaaaagtcaaccttcttaggatcgacttgaagaaggtaaagatactccttcacatccacgaaaaagttcttcaatgtcaattgtacctagaaatcagagaatcgatttcatcacaaaagcagtaaaaatctacataaaagtaatgatttttcacaagttcaaaccaaattgcctaagaaaatgagaaaattttcgagaatcttcatcacccaaatgaaaaagttgagatctttatgggaagagagaaagacctgatcaagtttgctgagatgataataacaagttgatttatcaatctctgcaccataagaagatccattcttcttaaactcttcccattcttgttccgtactgattctgtatatgaactcttcctcagccatttttgtttcaccttaaccagtgtgagatcgaaaaatcgtaactttaaagcagacttgattcgattccattccatcagagccacttcactaaaccgatctaaaccggaaatcaatttctgtactaaaccggttttattagctaaaccgactcgtcgtcaacttcgaagttccacttccaataattacctccttcgtcgtcgctttcgatggtcgaaatcagttggtaaagaggaaactctgaaagttgtgttaaaaaaaaaactagaatc

SEQ ID NO: 4818 - DNA, 2000 bp, Arabidopsis thaliana
tctcatattataaaagtatgaaaatcatgtgtgcacatagactatatcacatctacatgaaacacaaacacaaacacatggatttcttctaaacacaacgacatggatataaatccagtgttatcggcgtattaaaaaaataagacaatgtatgagtgtgacaatcaaccatgtgaaatcttgtctttctataaatatactagtttagaactttttgttttattttatttatttgttattttactatatcttaagataagcttatgccaactgactttcaaattaaaatggaatattctcgttttgttaggtggttggatctcgttttatttaaattttcctatatccgtcttaccgagtaatttaacattttttacaactaagaatatgctcttttccgtccaattgggaatatgcttaacaacactatcatggatgattatcctaaatgtacaataaatttactacttaatcttcattcatgttatcatgttaatatactattgaaggattccattgtaaactatttcatggatgataatcctaaagtgtctttggcttccccagtcaatattaaacaaattcaacgcaaactttttaataacagtaaataaacttacccaacattaatatttgaccaataaaaagtcataaataaagctttgaaaatattaatggggaagaattcaatagttttcgaaacatcttaaaccttactctacctaataactagacttaaaagcaaagaatcgaattaaacgaaccaccccactcttctgctaataggcaaaaacaaattccaggtgtaaaagcacgtcagcaagagaaaacacgtggaccaatgatgtaaaaacgtgcacggaacagtaaaagaagggataccacgcggtatcacagcctcataatattcccttcaaaatgggaatattataattattatccaatcccgaaattaactctcttttttttggttctgacaatgacaaacaaaataggtttcgtgtagtaagagtatcctccacgtgtcattaaaaacaaaaaaaatggttcgaagagtgactggctctacccggtaaatccactatccttgaactgccacatccggtcgcgtggttattatttattttatttcctctacttacaaaaaaaaaatggtgtatttattttcttcaaatgggggtttaagctttttttcagttgtttggttttttctttttcaaagggtttaatgtcttcttcttcttcttcttcgttatttctattctagaagagagagagagagaaagacaaggacgatcgttaaatctttttctcttaaatcttagaatttcaaagtctctgtaatttttttctcttttcatttgtatagcacaattgttcttaatcagagattcgtgagaggtaaaggtagcgtaattattcagtttgcgtgatctataatttaactggcgccagattgtgatccaggaatcgttggcttgttaggtgagtttttttgttcatcacaattcatgttctcaattctgtttttctgatccacaaactcaattcatgttctgtttttggtgacaaaaaagtattgaatctgaagtcgaataaattatttggcggtttgtcagaagttggcaatcgagatctgattatgttttattgtttgtttctacgtaaattgtgagcatttaagttacatttgtttcattgatctaagtttttgcgtttcatctatacgttgcttgtttcgctgcatttttgcatgttttttaaaaaacaaacaaagtgatcaagggtttggtgttcattgttgatctgaatctgtatagggcttagttttatcttcctgattttttttttttttttgcatttgacctcggatctgttgatcattagtttaagaatgtgttcaaattatactgattagcttaattttgttggagatgatcatgacattaaaagtctttgatttttttgcaggttgttgttttgttatgcataattgagag

SEQ ID NO: 4819 - DNA, 2000 bp, Arabidopsis thaliana
ccatctccatcaatggtttctcattgagaaactgtttaatataaaaataaaatataattaaaatgtatgagagagagtagaattagtctctcaaatgagaaactctgagaaacccataagaacacttgtatatttggtcaaatattattttattattaaaatttaattatataactaatatttattaaaatactaatatttcttttttttgagaaaccaagaaagtatctcactgatggagatgcacttagtataaaattcaacgttggaataatacaaaacgaaataaattaatacttatagatttcagcttcctttttaaaatgcttagattgataaattttctacttttttttcggtgtgccagtctttgtttcagtttcagtgaaagagaaaaaggttatctcttgagcggtgtaggaaggtgaagtaataaatgaagaggatacatcaatcgagtggacacgtacttgaagttgtctgatccacttcaactttgaattgtgagtgtcgtaacaagatgccgtatctattaaaacgttaaacacaaacaatttttaatcacaaatgctattttattggacgaccaaaataactaatgaaagaaaaaactagtatcctgttactagtttgacaaaagttattcagagatgaattgtctgcatgttggtttatactacgtcttaaaatttatataaagatattaaactttgtcatggatatagtaattgtgtatccacaaaatgcaaagatagaaaaaagtcgttatgtttgttgaaagcattagatagatatatgtctcccatgtgagtgcacatggagttatgcatgcacgaaaactgcctctacccttttgtctctctctcgattcttcaatcaattccccaccttaagtttgcatgatctctatatccacctctgagatctagacacgttgctcctcctcttcatcgaacggttctctttgatcatcttgctaagagataagaggaaaagtggcataaatccatgccgagattgctcttatcggtccctttatttgttggttggtcccaatcacttgcactggatatgtaactgtttctccatgttactccttctcttttaccaatatacccttcattttcttcaatttgggtgtagtcccaaatgtgactcttttggcctaattgtatcaacttgtttactttttcttatatatgttcatcaatgttacgacgaatgtaaaaaaaaaaatattatttggaatttgataccgaatctcgacactattagtatattattggacccgtcatatgtatttatcaccagagagatgtgagttttacgatacatagtttttttctttcatctgaaaagaaaattaaacacatgtaaaataatttctgcctgtagtcttttaatcactgaagtaactcgaatttgatgttagataattttttcacaaaaatattcaaattcaacagattaagttgttgatgacagatagctctctgggaggaaaaaaagaagaaaagataatggtccgtattaatatagttgaaaacttgaaactactttttagtttgtatataatacagtagactagggatccagttgagtttctttctttattttgagtttgtgtttatgtttgattttacgtttttatatgtaaataagatattttacgaattatggttttatttgggtagaagttgtagaatgacttaaacaatcaagtggcagaatgagatatataaagtaatataatatatgtaccgttattaacttattgtacatgtgaatgaggaagcttacacacacacaccttctataaatagctgacaaaactggttgttacacacaacacattcataaatctctcaaagtaagaactaagagctttactacagtcctactctctacacatcttctctctctctcaagagctagtcatggccaaactcataacttcttttctcttactcacaattttattcactttcgtttgtctcact

SEQ ID NO: 4820 - DNA, 1958 bp, Arabidopsis thaliana
gttttaaatcaaacaaaactaattccatttttttttctggaactgaatatgaacttactttatcaaaaattcattttatatctatctacttttgtttttgtcgaatttaacaaatatttttagtatgagttcctaaaaagagtttggccatttctcatcagattattattttcctttaaaggtcatatttttggatatttatctgataataatttgaatcattggacatattaatgatatagtttactttatttgttaggatgtttgtatctactgtaaagaggttgcatgttttaaagacctcccacgccttctcactctcacgtaagattacaattcttacgaaactttttcatacatctcatcacttaattactgccttgaaattaacttatatatttatttattttttcacagctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaatgcctgatatgattcatgccttcgtttcgttttttagtagggaaaatggtatttaattagcgaaatcaaaccgactcattttatgtttttttcagagaggtaaaaatccagagagcctgtttactatgtatgagtaaagattacccgaaataatagagaaatagatacaagaggctatccaagtttggtgggttcgagttttataacaccatccaaaaaaaattgttgttttgtaacacacatgagtaccaattgtttatttcacaaaagacaaaccatttatttcatgaactgtaatcttgttatgttcatgaattatttcggtataacatgtaattaactcgagtaatatcttaaaatagtatttagagtaaagatagtagggagaaagatactttatttttttataactcatataattttaaaaatttcatacacccaaaaattgattatggagtatggaaaaaccatgttaaattacttaaattttggtggctaatactactcgaactcagatggtgaaaacgactttagacttcattaatataaatatatatatatatatatatatatatatatatttatatgagtttttacttattgtcaattggttttggaattagtaatctatgaaacttaacatagtatcagtctatcagaggttgaacattcgctgacccgttaatccaacttggaaaatggtccgattacctctactaattgatgatccaaagaaaaactcaattatgtcgagataggtaaaaaaacattattttaaaagaaataatgaatttaaaattagtaaataaaatttaaaatttaaaaattctcctataaattttgtgtctcacaactttctttcaaactttttttcttcaaaaatataccgtatgctgatgaaatttttatctttaccaattaagaatataatcttttgtttccatctcaaatcatcatcatcacctccaaagcgtttagcaaccccaaaaccaaccacttggcgactacacagtattttactcaaaacatcacaagtttctatgaaacgtaaaacgatgagtttagtaaaaaaaaactagagattatagtcagaaaaactataataataagaagataacattaaacggatagattcatgtctcttttttgaaatccaaaattgggtaaaatccaaaaaccaaaatcttgccaaatgccaataagagcaaaaatccaaactttcctttctcttcactattacacaatgaaatcaacactacattttcacatcaaaatcacattccttcc

SEQ ID NO: 4821 - DNA, 882 bp, Arabidopsis thaliana
aatttggatttgactttgttttcaattatatatcatcgaacttgtgatgtactagtatgaacctttatattcgatgaatataatatgaaagtaataaagtttgtttgcgataatgttgttgatccagagatttttctttaatcataaattcataatagttagtatggtgaatattggaattaaactactaaaccttttgctcttgcattagtgggggtcgtggtatgagtcgatgaccagtaaaagacaaaattaataaagatcttaatgtaaatgcgttggttgttatggacgacagctctattagcataattaattagcatgacttgatgatccttcgtcaagtgatagtcatgtacacgtctaagaccaaatgtgaaaattgtgataatcttgaaacctatatagtactatttcatattttatatacaatgttaattagctcggagttaggtccactaactaagtctaattactaaaataatacaatcttctaacttaacaactaatcatggtgcacatgcaaaattaaaattaaaaaaaaagatttggaggattaatactccaaagtccaaaccttggatactccgcctctagtcagtgacacgtcatataattagcagacgataatcggaagagatttgttacagtgtcactgtcggttgcttaatcagcaatctcattcaaatggaatcttaatacatgtaggaatctttttcctaagaatcatatttgacacgtcatcatttcttaaaaatcttttgatcctcctacttaagtagcactaatcaatccctcactaaactctagtcttaatcacactatatatatatagtactagtgtgatttgcccaacttgtcatcattatctctatctaataa

SEQ ID NO: 4822 - DNA, 2000 bp, Arabidopsis thaliana
taatgttactaagacgattgggttgttgggattgttgtagataaaccaggcaataacataatctaccaataacaatgtattgtatttccttttagttgagaaattaaatatttgaccacattatctgaattttcttgtcgtcttaataactaattatcattattcatttttggcaggatctttttttctttgttaaagggtctacttttttttttgataaagcagtcttttatttttaaaacatgcatcacaaaatttaccttcatgaatcaattccctgtgagacaatgatatgatttaaagtttacatgtaaaatattctataccgtggaaaaacactcatttcattgttatataacgaaaaatatgaattatatggacgcaaaataactatttactagatatatcgatgttatagaaataatattatattaaaaaaaacgatatatacggtttagtgttagtgtaagtttatatttttggcacttgttgaaaacgttatgataacttgtttattatcaacctaacatgttttatacggctataccgcataaagtgtagaattaattttacctctttatatgacacaataatatttaacatgtaacaagagcaaggggttacttgtcaaatacgcctatgcactaaacaatgataaattggtcattctcctaatttaaaaagtcactttatcattcttctctaataccaaacctttctatataatcactcttaaaccggccgataacttgttttccaaataatctaaaacttatactaaccaaatttaactaaaatagtaataatttcttacaaatatcaaatcaaaaaatttcaaatccctgacttgtcaaatcaaccatgtttcggactgagaccaaagtctctgcaattcaatgacacatgtatattatatagtattgtttcattaatcacacatgtattttgaccgttaacatgccttgttctttacgtatgttgcactgcaacaacgctttgtcgttaatttacctaacttagtaaaaacaaaatacatgtcttagattatcagttattcaaacttgtcgttatgtaattgttattgaagtaaacagaaactctggtgcgatgcaggacgttactcaaactgagtcacttcgatcggatgtcttaattcaagcaggacaatctagctttgctactgaaatttgatgacacgatgatatatatctatttccaaccgatgaagcacactggagatccgtttggatttttattgtttttacttttttacactatcgtaatcattctttacatatttcctttttattttctccttagaagagaaattatttgtatacaaaacttagaaggctaaataagcatatttattcagtataatcactgtaaccacaccttattcaataaaattcttattttgaatctgtctatttatgtatatgatattgctatagtgatgacagatgagtaaacattaaacatacacgcaacatagctatcttgaaaactgtttgatgatttgagacaaagagaccaaaacaaatggaaccttcttcacatatctatcacacgtcctcatacaccacccatattctgccatgtgttctcactccatcaatattaattatttttagggttaatagagatggtttagtctcatgctttttgtttattactttttttctttggtcagagctttttgtttgttagtaaggactttaaagatagagagtaaaaattactcttttgttttgtcaacataataagcagtttttttctacttcattttgtctccgtatttcatcaagaaaagacacgtatttagatagatgatggaagggcggtaccaaatctccttgacttgactttgcatgtaccatatatatatttgtatatacataaatcataattcatgaagaaaccaaattttctctgtaatcaagttctcaaagcttattagcttctctctctagttctctcacatataacatttgaaaaag

SEQ ID NO: 4823 - DNA, 763 bp, Arabidopsis thaliana
agtagtactacccggtttcgatgattttggtatatgttgtgcttcatcacttctatatctaagcaagtgagaaactttgttgtattgtaacatgaattgttttatgttttggattgtaatgttttgtgaacttgggttatttgatcggttttttttggattgtagtgttattgtcatcattctcaaatgagaaaactccaacaaattttcttatattatcatctacaatgcttttgtagacttttacttagaaagaagaagtaatatagaagtagtttttttggatccttgtgttttatattcttcttatcatctaaaaatgcttttgtatgactttacttaggagtgttgagaaaaatctatagaaatagaatgttacatgactaaaagtctaaatctatttacatgtacttggtcttgataaagacatagaattgttattgactttggaatataattctatatataatttatagaagaatatctcgtcacaagtcgcgtaacaaagacttcataggtaagttaaacacgtaacaaaagtcacttgctttgcctgattagataaaggcaaaacttttgagattctatcatcaaaaaacgttaacacttataagggtattatcgatatatcacattaaaatcttaacctctaagtctttcgcgaatcacgaaggatataaatatccacttcattgccacgctcactacataacaaaacacaccgtttcataagatacgattccaaaattcagattcgaaaaca

SEQ ID NO: 4824 - DNA, 1849 bp, Arabidopsis thaliana
ggtcaatctttctccattggttggtactcgcaacaaccggaatgaatccagttttttttttcaaaaatttcataaacagtttgcattgagttctctcttttgggtagaaggcattccgatctagtcttttttgcaacgattgcttttgttcgaatgcttgaacatgtagtaaaattgaaaggaattgattgaaaatttcggtgaaaggtactctaaatagtaaaaaagtaaatagagaaacagaggcttcacaatgagaaattttcattcattcactaaaatcattcgtttagtcaatgaatttcctttatttagaagaaatcgattttagtttgaaacaaggacaaaatgtttgtttgactaaagggaagagaaacaaagacaaaatgttcacgtccatggaatgatcgagctctagaagagtgtattgggaatattaagtacggatatatgtttttaaaagatgattaaaaaaaaagtttgcagcaaaatcgtcatgtggatgcgcataaacaaaaactttagatagtaaaaatgatgggctatagtgatgatgagtgcaactctatcggtttcagcttttaggtgaagatctgacaagctagccaacaatatctcgacatttgtggtaacttgtttttcttttattttccgtttttaaatgcggaaaccctttttatataccgaaatagaaagtaaatctttttagtggtcattaatacatggaggttcccatgattagccataagcttgtttaatgcgagtatatgtttcatcagctccgtttcaggacatatttaaggggcaaaattaatccagtagccaaaaatgtacatatgtaagggacatattacgatattaatatatagatccactaacagaaaaactaattgttaatttaaattatttctatttcatttttcactgtgtttgattaaattaaattgggatataaaatcaattcaaaatctgttattttaaatctcataccattctagtgctatatttttgaaaacttagatatttttagtaactgttctaggcataaatttaatcaattaatattttcatattttttgctatactatttacaataagacatataataaatcggaaaaaattaatgcataatattatggagagataaaacttactgaaaaataaagagtaacaaatcacatagtttatactaatactttgccaataaaaagaaagtttatactaattaaaatattattttctatactagtcacggtaaaaaaaaacatttctaaaaactacaggccccattgtttgtcagaacgttgtaagtagaaagggtaaatccgtcatttcaaactatctcccatgctttgacaaatcacaattcaacagttcacagaaaaagcgaaaacttcttctatctctctcatctttctgttttgtatagcttacttcaagctgtggtttaaacagaacagagaaagctgtttcctttttatattgacagagaaaaggaaagctgatagagagagagacagagagagagaaacagagttcaagatcacgagccttccttcttcttcttcttcttcatcgagagcgatcaaaggaacaaaaaggatctcaagaaacccacttgtgttgttggttagatacttcacgggtctctgaaaacgtctctttctcacaaccataacttgatcacccaatactccttttctcatcttaaaggctcaaattcatccacgtcacaccgttgttcatttcctctgatgtcttggtgtcgttagatattgtctcccaaaaaagaaatcttcttgacacagagattgaagtcgcaaagagacagaggaaagagggggagaaa

SEQ ID NO: 4825 - DNA, 2000 bp, Arabidopsis thaliana
atcagaccaaaccgtatttaattatatccaaaatcttatataaaattgtgattatcacaaagaaccaagatttgtacggtgtcgacacaaaacaaagaagagaaacaaaaactatttcaaacatgtcccgactaatcttcgttcgctcatatgcaattatgcacgtgtctacacatgcgaataatttgttcaaatatttccttttgtcatctacacctaccacatgtaatttaagacctcactagctgtgattttgatatttaagaatataccacatacagttttaaactaaatatttgatatgaatgaactactaatgcaaagttgcaaactaccgctaacaatcaaactcctattaagttatgttttcaaaacaggttcattgctttaatgaacgtcactaattcaaacctaagtaaaaaacttaacttttgtgtgagtatctacttgcagcaaataattactttttgttttgacaatatgttcttttggagtttttctcaatattttgcaaagagttggagtctaactctctgcttaaaaatcctacggagatgattacacctcttgcactatttatacatatccttcaaagttttttgaagtctaaattctctttacacgacatagacaaactttcttactttggatggtgaaaaaatctggttaacataccaaaagagtggtgcaatagtggttactattattaacgtcatttcacgatattgtaactagctagttcaacagttaaaggtaaatttatatcattttttttggggacaaagtaaatatatagtatcattgtttcaataatttctgcattaatatatatatccacagcattaatatatttttcataatgtcatggtagataagatttgctcgaaaaacgaccctactgaattaacaattttttttgtttatttgtcaacaatattttttttttcctgaattaataagtttctgtgaagctaccttcttcttactgagcgtctcctgtgggttcccatatacactgttttctatcacacactttgttgtttacttgtatgtattggaatggttcataaactccataaaccaaaagaatcgggtccaattttttttccaatatctaaataaattttactctataaccaaaataaccaaaattgaactaaaggaatttcgatatcattacacattacattttaaattctataaccaaaaaaaaaacgaaaaatatataaaagactaataaattgtccctacttttctaaatgaataagtttcggtgaagctacctttattacccagcgtctcctatgggttcccttattacactgttctgttctctatcacacacacactttgttacttgtctctatatatcattttaaaattaatatctttttttttcagacacaccatctttgaatcttcttcactcaaagctttgtcatattcaacgaagactttctttaaacaaaacttttaccgcatttaatactcgtcaactacacacacacacactatacatttattcagcttgtgttgtgtatatatattgtgttattcctcaacttggttgttgtattcaatttctcattcctccttaagttttctctacacaagaagatagagataaagacttgacctttttcaagtcttccttggtgttaatactctgcaaattcttgaggtatgtctctgattcttacatgggtcgattataaaagatgaataaaatcataaagtctccacctttatggagttattctgaatgtgtttgttgaaatgtctgaatgagattagatttttatccatcgtcggctataataaatgtgtttggtggtgatgataggaatgactcagtaaacaaattaatatattaatgatagttggcttagagaaaaaagattcgtttgtcaaagtttttgatattgatctgaatttgatacgtgtgcagggtagtttggaggaagagatcgtgtttaatattgttgtttaatcagagaaag

SEQ ID NO: 4826 - DNA, 2000 bp, Arabidopsis thaliana
ttttgtatagaactacaatttaacctttcgcaaaaaaaaaaactacaatttaaaagttgcatggtgacagtgttttatgttttatcggaagaggtaaaaaagaagggtacgaacggaaacatcgcacttgcatgtgaaaatctgatgctactttgtaacccaagtggcatgtttttgttattttctcctattttctagggctttattttaagttcaatggatacgccaaaattgagttcttcttcttttttttttgtcacggaaatttcctaaaccatatatattacattagtaagtggagatagattaaatgttaagttgtgcaaaggaaagaaaagattaactttctttatttcataaatagaattgaataagaattatttttctaagatatggaaagttggaaacattgaagttttaaatcaatgaatttgaagaagaataagtattaaagtatcttgtttgttgaatttattattttgtgttgtgttttatattgtagaattaatttaatgataattttaatcatctaaatcgaataaaattatcaaaattattataattatgtcgaaaatatatgttatcataaatttaggctatgaatagtgacatgcgaatatgcattggagtgtggtttatctacattatccgcattttgtaattattctgtactttttatttatttgtgaagcggtattcaacggtgatgtgcggttcaattataatcaactgccattttttaaaaactattgtatgaattgtttttttcaatgaatacaactttgtttggaggaaaaatcaatcatccaaaatgataagtaaaaaatattcattataatcgtcatttaacttttgttttgttcgatctgctgacgcaattttcacatttaattcacttgatctatttgacctcgtgttttgaccgtctattctgttgtctcattcgagttttttcgatgatcaaattttttttcaattttgatgagactataagaaaataatctaaagtcataagtttattcaaaaaattaacaatcaagaacataaattacaaactcacagttgtttacagtaatgttttgaagaaaacggatatttcaggacatacgtaatattcctcaaaacttatctattttttaatgagatcaaaaatgtaaatttcatgaattttaaatactgtacagagtatttgttaccgtaattgtgactatagagttactcgaatgtaatttacagttgtcgattttattaatttctttcataatggttactaaataatttaataactcgaattcaattacggtaacataaatattcgagaacttacccaagttaacaaattaaggaaagcaaagaaaattatgcaagtaagtgaccgacacgtggcctatgatcctagtgagattagccggtaatcttgtgaagtaaaattacacaaaaagagttaaaaaagaaaggaaacaaagggcatccacaagcccaagcactgaaaatatttggaaaagaccaaactcaaactcagttacatacatacaccacacagagtttataacgtaacagactgtgatcacaatccaacgccacagatctttccattaacagacacgtgtcgtaatcatagctcaagtttcgtaaatgacagaaaacattcggttagaaaacggtgatgaaactattgccgtcgaaacaagacagatgcaggtgtttgggagtctcaacaacgaatcctcaccgtctgtttattttctaaaggttaataacgtaaatttaaatatctaatcggacggttataaagcctcttactctttccttttatatatcgtcactatcacctcaaaatgccataagagaaagcaacttcttcttttctctctctaaatttctcagagtatctaatctctctctcttctctcgttccatattatcatgcgtttcataattcagtaaattttttgaaatctgatctgttctttctgaagcttttgagagaataataaaaa

SEQ ID NO: 4827 - DNA, 2000 bp, Arabidopsis thaliana
cacgtagcacgaactcggatcttagctggcgcacgagcgaggatcaccgcacgtgtcaactgcaggtgagtttaaaaaaaaaagaaaaaagtagggcaaacggggtacaagggcagctgtcgtgggcccgggagacaaggacgttgataattgggcctttcaaaagagaggtgattgtgggtcccattaactcattaatctgagtcagctcgacgccttgttgtatcgacagatgacaagttgtgtggtcctaaccaattatgtaaaacctcctttctttttttggaactttattataattgatcacgaaaacaccttttatttttgtatgtattaatacactttaaatatatacatttttaatgttttattattggtttgccgttcgtaatgtgagtcattgcttactcagattcattgagttttcttgacgtgatcttatttaatttaataaatcatgatagtgttttcttacctttgatttaaaaagtcaaaagtctcatgttggaggattataatatgaatcaagagcataaaaatgtgatatttctagtcggtatctgatatttataatagtatacagaatttcacctatgtgacacgttatgtggttttagtattaaaactataattgaactcggactaagaacttaatactactatagtaaatgaataaaataggtcggtcaccctcttattcgttttattacaagtattagcgtatggagtatgtatgtacacattactagtagtagtaaatgtgtaaacgtattcgaattacatgttctagaacctttttaaaaaaaaactttatgactatttagatcgtatttttaaatattattgtttgaacaaagattttgccaaagactcttttacacattttcaactagaggattcttagctatagtattcatatcgatataaaatatagaatagaatagtactatttcgaaagagatttaaattcatccaatgtctttggaatattttttacttggacatgtacatgtgtaccaaaatgtttttgtctcactataaacacgaataaattaattcactctactatagtaacaataaaaaaaagacgttactgtcgatatgtccattgaagaagttaatgaaatacaaataagtacaagcaaagcattaaacaaaacgagaggcgattataaattacacacatgcaatgaaacattgtccaggcgaaatgaatcctaaggaaaagcagagaaagtacacacgagaacagattaataaaatagaaattattttagtagtaatattcatataaaaaattagaaactttctcttttttgtttttttgttaacgaaaatttagaaactttcatttaatgttaattgaatatttgggaaaagtccaccatcatgcgctatgcatgttattgtggccaacgaatcttacaaaacgcaagacttgtttgattctctcgtcgaacgagatccacccaaattattgtattcccaaaataatactaatatatgttctttattgctcttacaaaagaaataaaataattttaaaatttactcgacattcgtaatgtaattgcaaaaataaaaacaaagaaaatagtactcgtaacggacaaagagtttgattcattgcactttaactttatcgatgaggtaaaataatcagaaaaaaaaaaagaatttaccacaacacaaaaagacaataataaaatataataaaagtaatgaattattgaactttaacgtatagatctttcgagatgaagattcggtcacgatgaacggtgaggatgtattgtagagtactgtaactaaagtggtacgtgacacaggtgatcagctcaagtcaagcagaaagtcctaaagccggctttataaatgaacaccaaatcaacctccttcttcctcctcctcctctcgcttcttcttcttcctctcgaatctgcttttcgcagtctatttcgtcatcgtaaattcggaagctttcgtatttaattaagcaa

SEQ ID NO: 4828 - DNA, 947 bp, Arabidopsis thaliana
gtcccatacatatacattcactggtccatcatcagaaaccaaagttcccagcttttttgatgtatcattattcataatctgccctcttccctgaatataacaagttaaaaccagagatcacatcttacatcaatcgacaaaaggattcagtaggagcaacaaaattgagaatcgatgagaactcattcacggcatctacattggctactaattcaatgatgaaacaatcaggagcatgtggattgaattgagtttcatggcggaaacaaaagcgataaaactcccaaaaagagcaaacttttcagcaaacccatgactaatttcactaaacaaaacctacgaaattacgattaacgattctaggtgaatttaatttaacaaaaatgagaactttcagatcaaacgaggattgataacagataacacaaagttcaaaacctaaaaaacaatacctgcgctgccgattccgataggaggatgaccaaagatagagagctccggagctaagtgacgacgatgcgtgtgtttcaaagatcacagacgaaagtaaacagcgagccacgcggcgtcgtttagtataatttagctctcggcccaattaaaggcccattatgttcaacagtcacacacaccaccagaaactgaagaaagcttgttttttttctcttgcatgacccttcgcttctcttctcctctcttctctaccgaagtttgattcttctcagctgagaaatacaactgccgatcagtaagtacttctaaactcgtatctataatctgtaagattgattaatcattttgccatcaattaaaacccatttctcctgatcctgctttggtttttgtgtttcatttgtggggattcaatgatcttcactctttcaatctctgtggaatttttcttttccttcagattctcatatatacatagacgtgctttaactctg

SEQ ID NO: 4829 - DNA, 2000 bp, Arabidopsis thaliana
tgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaaatgagaccggttggcttgatctttacggtcatgttcttggtctcggccttttcggaatcaagaaccgcggattgcagagttctccttggtggttcgacggaggaaatcgatcaatctaaaattcatggggtcgatttacgaagtgaagacttattaggggtcgtgatacatggttataagaagctaaggtggctctcatcggccggggagaggatgcatacaatggcttcaggaccgagcaggagaggtgctggtcactaaaatacgaacccaaacaaaacattatacttcgatatttgtttagctcaggtcatagaatcatatttttcattttttatagattattatatttattcagtcgctaaagatccatgtaaagtttagaagggtgatattctttgatcatacaatagtcggtttccttctcataaacaccaatttatagtacgtgcccattaatcgatatttattttagtttaacaaatttcaattttgagatctacgttaagccatcaaccatgcaaattgtatatgagtcaataatatagattgaggagatatgttatcggccattctggtgcaacttaaatgatatacagccacatgattatctcttttcctttttggtaaggttgataccacatgattaattataaagaagacattgattagttcatgttttaccacataattggaattaaaagtggtcgcaaattataatcaaacgtggtcgcaaatcgaatttcgatgagatgcaaacgttttttcagctgtaccttttaattcttttcttatttgttcgaaatgttggcctttggggaattaaaaggacatttcaaaaataatttattgtctttccataggagccggaaatggaaaagcttcaatcttcatgcacactatgttttgagtggacccaatttcgacaatctttttttaaatgaagaagataaaagttgttttttttggtaataatgtcgagtatttatagttttataccatgtttagtgagtatattgcagtttcacgttatgaaatttgtaatgagaaaattaaaggactaaaaaggcccactaaaagcccatatacattttcttttaaacacaactaaaaaccagtgagcaaatcctttctctttttgcatgtgtgtgttgtaaagcagtggacagagacgacg

SEQ ID NO: 4830 - DNA, 658 bp, Arabidopsis thaliana
gtttttatgaaggctggtttatgtgttttgttttccatgtttctgtcgataaataaaacatctgaaggagatcaaagagttttcaaatgggtcggttaaggttttatcctgtttcctcttggatgtattacagtgatcaagcaacttttgagtgtatttgtgttgtttcaacagcatgtaaattatctaatgaaatttcggtcgaagtaataatacaacttcgttttgcttctattttcttctggattaacgattttagtaaaaatactcatttgggagaaaccaatttcttgggtctaggtttgaatgagataaaatggttaacttcctaaccttctaagagtgtccgaggattcattcgcattctaattgggcccaggtcaaggcccaggaccaggccctagtggggtaaaattttgcacgcgtcggtgctttgttttggatgacttggcgagaggtgatagggtagtgtcacgttggcgagcgatattcattggaagataacaatcaaaatgacgttcgtaggtctaagaaatacgaggactaaagagtaaagaatatctctctctctgatctacttagtacttacttagtagttacttctctgtcttatttgattttgagtctctgttttgtctcttctcttgagattgcgata

SEQ ID NO: 4831 - DNA, 409 bp, Arabidopsis thaliana
ggtcgcttattgattgttttctctctccgatggatgcgaataaacgaaaatcgaaggttgcgggagagagacgcagcgacgaggggattctgaagtgaggtcctaagtttggtatttatagtcgaaactatagcgtagggttttcaggtaaatttacaattctcggtaaattacaattttgggctttaactgtttccaattttctattttttaccctttccttttttttaaataaaggaaataaatctgaaccgacgcttaatgagccgggtttggtccaacgggtggggattcgagtgttgggctacgtataaatagtgttcgggtcggataaaatcctatttccctctcttctcttccgtctttctcgttctgtttctgattgttcgtgtaaaaccctagaatgacg

SEQ ID NO: 4832 - DNA, 1496 bp, Arabidopsis thaliana
tctaagggatgtatttcgagtgaagtgtttgatcgtttgcatttgtgttttctccattttataagacaaaacttatatgtgatgtcttttttattattattaattgttggacaattcttgcgtccacacttatcttatttaccctttcttaagttccttattaaactttacattttttttaacaccatcaaaaactttctctttaagttgtttattacactttacatttattttacaccatcaaaaactaaggtcactaaataaaaaaaactatgaagcctcattttcccataggagcaatgtgagacatagacaaattgagtaaacaattacatcacttggtaaacaatttttttaatatttaattagtattggttgttattgatttaaattttatatcactttctaaataatttaaaatcgtatatttgtatcaagtgatgcaaatggatttagatttgtatcaattttagtgaactgatgccacataaactaatacgacatcgattattgcaattgatgttaaactataattcttgtatcgattgtaaacaagtgattcaaattaatagcattcaatttttttcatgcaactacttttttgtttgtagtatttgttggatagaacgtaatgttatggcttaacatttaaacggccagaactatccacactctccattttggacagatcaagcaatggaaggtcaacattgttttggcttaaccatctaggagccctatttatttgtttttaattacattttaagaaaaatgactaaaagaaaaaatacaatgaattaatatatttaggataatacagtattcaaatatttacattaatttaatatttaaaacagtataaagaaaaagaaacatatctaattagttttataggtgcttaaacatatacgaattcagtagttcttagcaaattttaactattgaactttgtgttcaaaataaccttcctatgatgtcaaatactgaaactattttagaactcttgtgagttatcttagcaccacattttatcacttataactctttttttattatttttaccaatagaaagtttataaccatgtttttataccaattgaatttcttatatttttcaaataattgtaataccaaaagatattcttagagtaatgtactttacaaattataaaagttgaaaatagcgatatatgggctccatctaatgatctcaatgcgggaccagcatgtgatatacgaatgtctatatacattattttctctgttttgtaacaataaacgagtaatgaaattatattttattggcttcaatttgtaacaaccaacaagaggtcgaatgagccaactagaatacagcccacgatcaataatcaaacctatgaaacttccttctctctttcttttaacatttccaaacactatatatactaatgtcacttacctcgattgtccatcaaacaatacatttgagatatcaatactcctgtgagaacaaa

SEQ ID NO: 4833 - DNA, 2000 bp, Arabidopsis thaliana
tatagatatatgtatttttcaagtatacgatataccaaattagttacgacaaaatgcgaatgagttggtagtaatgagtaaacctcaaaatactgttttttttttgtcaacaaacttatgttattatacttggatgacttaaataagctaaaccgaaaaacattgtttaacctcaaaatacttatttaattagttggtagcatcgttacatattataattacgactacgagttagattctcaaataatattcccaaatggatatatttacatcgattgatgcatgcttatttgtagtgatcgtcccttatgtatattatgtttttattttattttttgaacatagtataatattggtgggagaagacaaaaataagggagctctgccatctaatacgggaatcaagatatctgttttacatcaaacaaagactagtgtgatgaaatgaaagttaagttaacaacaataaaaaacaaaattagctgaaaatgtaatcaaatgagagatccgaatccgatctccgctaagtaaagcgtagtgggagcgtaaattcgcgtgagtctgattctgaatcgtatcatacataccaaatcaaacattaacgtttatgatcttacttacccatatcttatttcttaatttgtttggttgtttgtaaatgagaaatacactatgataagagaagaagatctaaatgaggcatagatctctagataccaaaacagataacgccaccaactaacatccaattaaggatatataacacggcatctccctctttagtaagcttacgaccaaagtagtgtgactagtgcggaacatttttgcagttaatactacttagcctcaattcttaattatgaccgtatgggacagggtaggtaggcacaaagcggatattgtttttaatatatttgcatcgaatttggtttgttggatcgataatcttttaatatgtatccgcttttgaactagtctattctccgattgtagaatgaaacatctatccgaaattctaatttgtagtattagtgatttgttttgtttttaacagtattttaatatttgtttaaatttgtaaacttatggttatccagactttttgaatcattcaaaagtggaaaacagatcgaatggaagtatagaacactacaatatattttcatatttttcttagccgtaagccactaatattggatggacataaacataagagaccccacaatatttatcagattaagcctttattcacattacaatgtttcgttctcaacttctcatcataacgtgaataaaagtaggagttagaattagaacacaacatctctaacaaatctcttatctgcattgctttggagagacatgtttgtacaagaagaaaaatgtttatggtcagtccgtttttttcatattgattaccttttaaatcccatttggtattaaaaaaaacccacttctaagatatgtttcgctttttatggtaacaagacatataacttttcaaagttactgaatggaattcttgacagaagttgttaggacactaaataatggaaaatcaaaatcaagggttacattagagacacgcgtacatcaattatttcttaaaatgcaacttggtgtacgacttttaattcttgagtcctcaaacccgagcattactccaccctttcttttcgcaataatcaagatcctaatttaattccctataagtattttttctaataactatgaaaataaagaaaaataagcgttgaagtcataagtttgaacaaagacgcgtgacctggaatcgtgctcaagaaaaaatatcacaactaatgaaaacgcaaggtcatgagtattgaccttgaccgggcaagagcctagagccaagaggtgatgtgtacttaaatgtgatagatgctcccttcttcttctctcatcactaacaaattaagagaagctgatcatcagattgaatcaaagacagactttgacttttctttgtgatcgaagat

SEQ ID NO: 4834 - DNA, 2000 bp, Arabidopsis thaliana
ttttctaggcttaaaccaatttgtagcgtgtgttttgtctgccgagacacagacgaaatattacaaacccactaatatcgctacccttttttttttgtcactcactattctttaaagtgattggtgctgtgatgtttatcactagtttagaccatatattgcatcatttctttgaatgttttaaatatatgatcgtcgtctcttcgtgaacatatagacacacaacatgtataaaaattaaacgtatacacacagaacgagagattttatagataggtaatgatatatatatatacaaagggcgtgtcgtggggatttggcttcatttcaagatcttctgtacacaatacatgtgagcaaggatcttgttgataaatgataatattgatgatgattgttatcatggtgatggtgatggtcatgatgatgataatgcacgtttttttttcttgaactaaatgacttaaactcaactaaagaaatatcttttgttagaggcaaaagagaagtaagaaaggggtatacatataagagtggagtctccaacaaagatatcattctcttttgagtggattaactccacgcttaattaagtgtgcatatcccatacctccagatgtgggtcccattctaattcttctgtttcttcgagtatttatgatcctgtgtcactaattgggactattgttttgctaatgacgataatattccaacttttatttccaatttcatctatttgtgtttgaacctcacaataatctctagaaactataacagagttatgttcttaatcatgtgttgataattttagatacaccaaattcttctgtagactgcggaaattagtcaaaaaaataatataacacaattactttgaatttcgattcaaaatattttaactattcgatgtgtatttattatatatacgattaaataaataaaaaaattgtaatgtgaaaatatcatagtcgagaggggaactgacaagtgtacatatgtatctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaacgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcatgctagcatttttcattttcccttcatttgtggataacgcacgatataacattctacacaccaacaagattctataaaaacgcaaaggttgtctccatagaatatcgtcccatcaccaaacattaagtagcactctttttcctctctatatctctcactcacactttttctctatatcttctcctcaacttggat

SEQ ID NO: 4835 - DNA, 1631 bp, Arabidopsis thaliana
tcacccgacataccagaggaataaaagagccgatacatatgtgctgctgcactctcctgtcgctctgttaaactaagaaacccgagaaaagagaaaacataaactcaagtcgatctctaatggtgtaaatgatgtgttgtgcaagtactagtaggaatgttgtcacagagagcggatttagttagttaatgttcatttcttgtatgagtgttggagttcgtgtattgtacataagtatatgaggttcgggtgagtttgcatcaagtctcaactcttggcaaagagacaactttactcgagtctgtggctcgttatttggctatggtcacttgtagaggaactcaatttgagatgtttctgccgattgttggatcaaattatatatcatgatgtttcataatatttctgtttcctagactattaaagtgtatcaatggtaagtttctctctctcttctctctttaatatcttttagagaaagctaaactttccgatcaaacctttgccttctggtttgattcgaaggctcatgttcctcacatagtgggctcgtgtctggcatctctgactactttagcggagttggctagctttcttctgacagcgatggcttccttagcgtcgtcttggtcggcaccactccggaagcagtagcttacatagtatcgtcttgaccggatttcgggtttgtctccgccgttgttatgtttttcttccagttgtttatttacttacaataaattttattagggatgtgttgataatatcgattgaagcgaattatcgcttaatgaagtgtattattcgatgcttttacttttgagtttgcaattacaggaattgattcatagcttttcaatgaattatggactcttattggctttgatcaatttttgtaaaatctgtgccgctgtgtttttggaattcgggaatcaattgtcttttggaagatcctttctttgcaaatttgatgatgatgtttgttgggattctctaattaaaaaccgatggacttctgtgtttaaagttctagctgtttccggtggctttggagttttccggttgttgctgaacagatcggcgatgaacggtgacgaagaatcatctatccacgtcttcaactttatttgttagcattccacgtggctttgcagtcgggaattatttagcttacttccttaaaggattatgtttctcgattgggcttttctcgttgggcctatggttataagtttgttggttttagtttcatatgtatcaagacctgtaatattgagtttttacaacacaagttataaataaaatacaaacactttatgagaaaaaagactattaaagtgtagattatggactaaatcttttaaaaaaaagatagtaggttcttcaaagtgtatcctactaaattacaagggtttgaacgcaaatatttctttgaaaatctcataatccagaaagaaccaacgagagaatgccacatcatccatccgtaatcgtatcctcacaaacaaaatcttcttctgcttcttctcctgcttgccagaatccaaaaccaaaccttcagatcataaatccaaaaccactcatttttctattactgaaatttttcttagagaagaagaagaagaagcaaa

SEQ ID NO: 4836 - DNA, 2000 bp, Arabidopsis thaliana
gaaattaggggtctaataaattaaaggacttttttttttgggtgcacctattaaaaggactatattaaattattgttgcctaaaagggtaagtacgggatcacctggcgtgacatgtttaattacccaaattagacaaattacttttgttaacccggtcaatgtttctttatatatcaaacgttcttaatctttttataggtaaaaacgttcgtaaggtcaaaacaattgaacgacgattaaaatttgccaaaataaacgtttggcatccatagaacttctttttttttccctccaagactccaaccaatatcattatctactcgaaaacatgtctggtaaatctaatactataatatagatctaataaccagtttagaattcaaagaacgataaaataaaattaaaaatcactttttcacataatcagcttttgatattttccgttggtgaaatttgttgacggttacatttcattacaatacttttttttggataaattcattcatttcattacaatactttatatactatttttttatattttttttcagctacatacatatgaatgtatatttgaatccaatgatatagtgagaacactagcacacaaaccactaatacttgtcaattttcttgaattaaaacctaagtttataatatataaatttttaacaacttaaactataagccttataaaaaatccaaccacccgattgtaaacatatgttttaagactgtgaattgggtcatttcaacttttaaacgcaagtttcaaccatttacatcaacaattgtttcatcggcttctacttggaaatttggtttaggtaactatgcacatcttgaaaacgaagtgttttctttcatcatttattattattcaccaaacccaaatcactacttcttttaggtagctttaatgcaatcttgaaaaaccaaatgtttctaccaaaactacatctgaccccactctggtgatggtgcttattcccaccgtttattgtgaaaaattgatccagtgaaatagctctaaattttatcttcttcatcttttttttacatcatcatactaatcagtttatttgccctttttgaacttgatttttttttccccaataaaaacgcagagtagtttttgagtgggtaaaaagaattgtactttcagtcagaacactagttaaataatttcttcgatagttccaataaaaactctccacgttcatatctgtcagaaatcagaatcatatgcgtactttgtctctctctttctctctatagaattctcaatttgcctgtatcttttttactctctaatcagctgcagagaaagagaagtcaaaacgcagctctctcttgcgttttcttcctttctcctttctcaattccccagagaacaacataactctgtaaaagggaaactctattttgttctggtaacttcaatagtcctcgttttatttcagtgttatattcttttattcgatggtcctgaatcgaacaggacccaccgatggaacagtgagaatctgttttcttatataaagacataatttttccagttcgttgtgtttatcctccatagaaataatgtcggggttggtttttggaattctctaagtgttgtttattgatttttgtttagttttgctgggtttactgttgaagttttgatttttttggcatattcttttatttgatacttgtttgattgttacatgttcctgattatctttggctgcttgttaattaacacgatatattagctagtatttcgatatcttttctcaaatttttttggcagttattgtaattagtatatgtaagctcttacgacattcctctttaggaacttttctttttcttgaacaatctttcttgtttgtgaaagttttaccttttttaaagattcgaaaccaattcaggttttgcttgtgtaaaaagatctggtcttgagaggaaggttggtttttattgtgttagaatcaaaagtagttttaa

SEQ ID NO: 4837 - DNA, 2000 bp, Arabidopsis thaliana
aaacacatgcaagagactagtaactagacaataatctatttcaaactaaattggtcttctaataaaaatgttatagttatggaaaaaaggatgtgtctttgggacattacagctctattgggccaacaaaatctctcgcttcgtatcccattagattctctctttctctctctctctctctcttccttcagagatgttcattgttcgtattattacggcatctctggctctgaccctctcgctgcaacatctgtccctattcagacagctatacctctattttcattctacacctaatactttatatttcttcaaaaatccaccctgatcaacttcctatcactatctaagtcattctcattatctttgtgttgttgctctcaagtctcgcccatggaactaacgattctctcagcctctaatcagtattggaccctagtcttaaagattatagtagttaccaagttaggacttaggacttaggatatagacttctgtcaaacaagaaagtgaatgctaagtttagaagcatttgaaagaaaaagtactaatccataaatatctacaagttgtttccaggaaaagaaaaaactcagtggggaaaacgagcacttatggtgtttacaaaatgaaaataaaaaagaagaaaaagttgtgtttgttattttttgggacccttatttctttaatagttgcatagcctctggacgaccagagtccacgaatgtataatcagataccaaaaaagtatgaaagaaatatataaagaaaaggaagaagaaacaatcatggcttggcttacttaaaaagtaaagtagctaatactcttaatcaaaactcacataataaacattagttatgtgtttataatgataagttaatgacctattcatcagaaaaacaagttgtgatatatatacttaatcaaaattcaccacgatctactaatctgctaaatttttattgtttacttgcaaaataaactatataactcaacacttccgaatttaaatttaaatttaagatgactttatgtcaagaagctagtagcatctttgattctttgtacttttcaacttaagtaaagaaaatagaaatgtgattatatggaggatattgatttaatcaatgtgtaattaagagacagagagtgataaggattgggattaagattaggtttaggattgggagaaagatgaagagagaggggtttaggtcgaccaactggttgttaaagatagaaactccttaaccatacatttatataacattttcacaataattttcttctctttaccaaagacttgactccaggaatcaataagcaagaagcaggaggttcaagcaccaaccagattatggctttctgaagcaatatcttcagaaaacaaaataaagtttttatttgattttcttattaccatattatatactattaaataagaaattcaaagttttttttttccattctttctttcttccggaggagggagagtatgatatgggtctttcacgtgtgacattgatgagatgatgaattcaaattatatctcataccaaaaaaaaaacacaaccaagagaaagaggcgtaaccttctgatttctttcttttaagatatcaataaaatctttcacattttctaatttttaattcttttcaagattttgttgtctccttcaacaatccatcagaagtagcagtttggtttccaggtaatttactaatctttttatttctatacaattcttcttttttttttgttgtctatggatttggcttgcatctccataattgcatgcataaccatatattcaagacatgttgaaatcttacatgtttcttagcaatacactgattatatggatcctgctctgtttcaattgtttttgaatctgtctttaatgtcaagcatttcctccataaggttaagttcttacgacctgatcagaaaacaagggactatggaactcaagtgagccaaaaagaacactccatttcg

SEQ ID NO: 4838 - DNA, 1212 bp, Arabidopsis thaliana
ctggtaaaaggattaatcccccacgattatggttttttgaatgaatgaatcaatgttcatgttcgttctcgtatcctacttgttgtgttttcttttcgttttgtgtatcacaaataccaacttttaaccatttcatctagagtaggactgttaaaaaatgtaaaaagtcacagttaaagcttgtgaagaaaaaaagagtgtaaaggagtaaaaatgagaaattcaaacaaagggggatgatgggatcattgggatgattggttctgtctgttcaattgttttcaaatttgagcacttattattgggcctgtctttgagctctcttattattatgggccgataactagtttggcccatttggttatcaacttgaaaatgaatgaagaaagctggggaaaagggtctttttaaacccgaactgactcaaaagcctcaaaaatttcactgttccttggttcttgaccggtttagaatcatggtttcggttttgaatcatatttgctttcttggacatgagaaagtaactgggcttcatcattgttttagctcattgggcccatattacgactcgagctaacgctgtcaagttaaatgctttttcactttctagagcattcttttttaaacacttcttttaaccaagagacggttcctacttctctaatatttttattttctagttttttggccagcagcaaaatattattttaatttagtgtcaagataattaaattatcattgtcttttgaatgcagaccgaaagtacatgagtcacataagcaagcggctacgattcaaccacgtgtcacatgaccaccggttcgaccgtttctttgtccagccgcgtgacacctgaaccagaaaagtttaatagccattttaataacagagccgttaattacacgtgacttaaaaagccgttatccttaacagcgttaacatctcggtcctgtgaaaacactttttatatgtccccacgacatttatcttttcctaagcatcgctctagttaaggaagcagcaggtttggatccgaaccaaccaacggatcagatcagaaacaaaatattcaacggctcagatttattctaattttcctccttttattgttggttttttcattcgacttcgagatctttcttctcagaggtgtaacgaaaacgctagaacaataactttgatcgttcttcttcttctcttgaatcggaaaca

SEQ ID NO: 4839 - DNA, 1037 bp, Arabidopsis thaliana
gttcggaggaagcagtcgattgtttattaaatttgacacttcatgcaaatatttttcattgtattttgcaagtagtttttgggattcgattagcttataacatttggacctcctatttgttgatttaattatttattactactttttttattttattacaacttagtttgtaatagtaaaatttattctactttgtgcccaaaactgtcaattgttgttcatttaaatttctggaattagatttagatacgctaaattaaatcacattttgcgtttatattcccacctaatttgaaaccagcaattattcttcttcataagaaaactttcatgtgctctctcgaaaataaagttttactctaataacaacacgcactttggacgagataaagcgattcaagtaaaattattatggttcaaactattatctaagatccgtttgtgtaaaacataacttctaataacatatatattctgatctacttttgttagtttttattagttaatataagcgttaattattgttctctcttttgcttaacatgtaaatattcccatggagaaagaagtacactttttgctttgagaaagaataaaaaaactctttattattactaaatcaagaaaaatataaaaccatgctgcatttatcatcattttacatattctatatataaggttctctaattcgtatacttttgtaaatagagaacaacgaattaaaagaccaaatcgatagcatcttacctttttgttgatatttattaagagaaaaaatcaacacattgttattcttcaagagaataaatttctggagacttagcagttaatgcaatctgacctcacgcgttttttttttttgacctcacgcggttttactaaaccgaccttcgtttacttcccttacctctctatatatatatctctatcttcatttgcatatttcaattcatttcataatcatacacctctctacatttgttactactttcttctaacttgttttcaaagagaaatcacaatctatctgttccaag

SEQ ID NO: 4840 - DNA, 2000 bp, Arabidopsis thaliana
aaacaaaaagtatatataatgcacctataaattaggcttagaataaagagaactggttaaactatggattaagtacggtacagttcaaatacaaacaaaaatatatacatatatatatatatatatatatgtaattttgtcatttactattcaaacagcaccggactatgcggtttcatcaacacactcaaatcttctacctatgagtaaaaattaacaaacaatatgaaatatatagttttactccttcataatacaatctctcttataaaataacaattctaaaaaagtatgataaactaaatatattataaaactttttttttaaaaaaacaacaacaaaatcccgcgcgtagcgcgggcactcacctagtcttcataatttttcatctacacatttcaaaaggtacgaacaatgatttgcacacactataaacaagtaagaaaagaagatttactgtgcttttaagtattatatataaaatagaaaattagaatgaaaaaaaaacataatattagttttctttttgtcgctatttatatataaaaaaaataatctaaaatgactatttgataggctaagattgtaggaattagtaccggtttataactgatttataaaactaatcacaaattttaattgttaatgtaaatattatcataaaattaattgtaagaatttataccaatttataacagatttataaaacgaatcacaaatttaattgtcagtgtaaatatttaattaaatcgatatcataagattatgaatatacttagctattttgcagcggaaagatgaaggaaccgaggttgtaaacctttccaaatgtgtgcctctactgatatccacatacatatagacttagtcaaacagaatgctagtactgcagagattaaatctcaaaacataacgacaagttcgtcttttatgtttagggttcggctgctcaaggctatatgtcaaacgttattatatatcattatatatagctaatacgtttaacctaacatacttaggtttagtaatgggcttgagctcaatcacttcatttcttattcgtagagagaaatcatatttgcctcttattccatgtgcacatatcaatatacatatacatgtatgtcaaatataatatatagatttgttatattattttttattataaataatatatataaataaatccaacataatattgatccaatttgtttaggtgtgtgattttgaaggatcgaataatattaatgatgaacttctcaaatcatcggctatttgggattgttggattcatacttttataaagttagtaaaaaatttatgttattttaattaaaacaaaaaaatctctgaattttaataaattttattattatgtaattggttcatgatttcaacattttttccacaaaataaagtcatagaaatcataaaaaatattatcaaaatagagagagcatttgagaaactttacaagattatgaataactaatcatcaagattataaaaaaagtctctagcaataatttaaaatctttcatttatttactttctataatttaattaaactcatcataatttcttataaattagaaaccaatgttatccacttagtcttataaaattacttgaatttatgaatgaaagtttacccaaaaaatatatatatatatatatatatatagctatatacagaaatttattatagcaacttgtcctatctttaatcaaagacatttttctttttattattggtaaataaacattttggaagcataaaatatgtaaagtaaataaatctttggaaagtaaataaatttagaattaataaagatgccaccagctcacgcaatctcaacgcgttttaattaaaaaaacgcgttattacgtcaccctctctctttcccttatttataaccaaatccttcttcttcacacacacactactctaaccgttttttttcttctctcaaatctcaaaatctcaatttcttcaaca

SEQ ID NO: 4841 - DNA, 2000 bp, Arabidopsis thaliana
ccttggttcaatccttatcctaattattgtctctggttacaaatatgtcgcactcaaacgaagagttataatctaaccggtggcaatgcctatccattattattattttgtaatatatattggaaatgttgggccacataaacaaatagataagatgtgacagccaaatttagttttcttattagtactttagtagtatactcattagaagctacctctctccattattacaatatcaatctcaaatgttgttctatataacatgtgtttactatagaatatctttattttgttcaatcagtatataacaattcccttttcgaaattgaagctaaggaggttttatgcgatgagggtgatacttacatgctcaccgaattcactcccactcgttattccgattcggtttttcttcgtgaagcgaggctcttaaagtatctgcaccggtgatcaaagtgaagtgtcttaagttagattaaaattttaatcaataaattgtaaaaatattaaacccaatcaaaaagtgacatgtaagtaaaaagtgtctttaacatatgtttcttctcttttctcctttcacaaatatttcaaatttatattaaaaaaaaatagtataaacactcgttaatataatcgatggaggtgcttttagaagacgtcgaagctatcttcaccaacatgggtctaggaagacctctctcgagagttccttgcctcattgaaagtcaaaaatattatatttttagctatttaagatatttaaatgttaataatgttgtaatacaatatttaagtcgtaaatatttgatagaccacataattatttttgtgcttcaagcctctcaaaactaaggaccggctttcacttggagacaaaaaatcttctgaagttcctttttcttgtatttttttcttccatttctattacttcacatacctaagtgcaaaaattgattgtatcatgaaactatgtatgttcgatataaaaacagaaatcataaattttgttaaatgccaggtaaaaactagcatatgttaatttgtttttgcaatttatcctaccataatactctttttctgtttaaaatttttaatatacttttagccaacgacaaaaccagtttatatgaaagttaagatgacaaaatactaatggtctacatatagcaaatacacaactagttaaattcttctgtaattttgctgtttacaatgacgattacacacattcttaaagctgtgatgacgaatcagagaaagctttaaacagctgtaaagattacacatctcaagttttagttaagtaagttattaacaagaaaaagttttgaaaaaagtaaagacctttaatagttttcttttctcggacaaaacaataaataaaaagaacacactttttttatcttttgtccttaggatttgattgtacatacatctgatctcaagtgatttcaagtggttggttctgttccttttctcgtccccgatcaagtttcttctcctaaactccagaatttggtcttgaagatctctaaaggctcttcctttttgttcatttctctacccagatatgtaagttgctagcttcttctgtcataactttaatatctgaatctttttccgatccaaatagtcaaatattcgcatctaggtcaaatcgattcaaaaccctttttgttgattgatgtgctaagtagttctgagttgattaagtctatcagtttaagagaaaaggattgtgtaagattatgattcgtacaagttagcttctttcttgattaggtccactgtgaatcatgcacacgtttatgaggaagatattagattgtgtaagattctgattggtttgatggtttcaagttagtttctttgttgattattgattgctgagtagttctaagttgattatgtcaactctgaatcatgtacaagtctatgagctagaaaatgaattgtgaattgtggagctaagaatgatgttgttgttttggctgaaagcg

SEQ ID NO: 4842 - DNA, 2000 bp, Arabidopsis thaliana
atttgttcttcctctttatgttttgagttttgttgtcctgtttcattttattcttacttttgttttctctgaattttgttttcagtgaacgtataatttaaaaatctgcaatacaaacaaacaaatatctaaaagtcaagttggctttacgcatgtgatcgacgaaacacctaattgtcttgttctttttcattcgtctgaataatttcatgaaattaacaagacaaaggttcacatttataaaaagggaacgagagcaatcaaactacagaagatcactacatcaaaataacgcatttctcagattctcagattcaaacacattcacctaattgttttgttctagctaggccttttagctatacaaattttgcattaacattacaatttccatcggcatgtaaacaattagcactaactaattaattagtactgcaatatatcaaacataaaagatggttaattaattcagtgtcaagttgctgatcctaatgagaatgcagtgctgagacaagatctgatgagtctaacaaaaatgtgactaattcaaatcacattaattactgtatgtagcaaacataagattatatatataatatatcacaccaatttatatagggaataaaacatatccttgtatgcaatgcataacgtagttattaatatagccttacatgaataacgtcgttaagataacgatatgacactataatgacgaaaccttatgggaacatcatgaaaataatgtaacgcgagttttgactttccaatgtaaacgaaaggagtagaaagcaacggaagactacgaatgaaagtatggagctacgtatagtttacgaaataattaattatacatatagaaaagtagtgagtcaacttttctttccatcgtaatcaatagcccaactgtttactatcattgtttgaaatatcctctgacacagaaatgttatcttatagtcaatttgacgtacaatatgctctcttaataaaatcaagaaatctagtttttatcaaaaactaaattttgtccccattccatggataatgttaaaacattacattcattatagatccatgcatgtgaatgaaaaggctcacgggtaaaaaggttattaaggtatcaatatgacctcaaattttggatagatattgaagatttcataccactttttttagtgtcaaaagacggaaaagtaataactaaactatactacttttaaaagtttgaaaattgaaaaacagattttacacctaatttaaaatatcagatcaaagatcttatctacaagactaaaattaaactagtagcggtctttgctgtccattgaccgagttttgcgggtggtttactcatttaagtaccacagcatcaaattaaaataactgtcacttgtcgaaagtgactagataaaaccaaaaatagctttaattgagtcaaaattgtagttctagtgcaaagtaaagagttatcatcttacaaaatgcgactcattagtgtattaattaattaattttcagtccaataatctggttaatttggtaaactatccaaagagtaattaaatgattcctcgtcataaatactaattttctacgttttaagcaaaaaagacaataattatttggtctgaaaactaaaaaaagacacgagattaagggaagaagataacgatctagaggaataggcaagtggaagaaccagaacaacagctgttcttttcttctaaacttcagaagtcagccgacagttaatttctcctttttttgaggttttgtcgaatcctataaatttcaactaaactcttcttcattttcaatatcaaatcttgtcttcttcttcttcttcttcttctttttcttcttcttacatttgatttctctgtctgaattcgagaaccagatctactaattacctgagagaaaaaagatctgctctgtttgtctgaaacagacagaagtcaacaaatctttcatttgttttttagcaaatcaaagaa

SEQ ID NO: 4843 - DNA, 50 bp, Arabidopsis thaliana
gaaaatccgccgtcttaagtggaatttggaatcgagacgcgaaaaacgaa

SEQ ID NO: 4844 - DNA, 906 bp, Arabidopsis thaliana
ctttctcatctaatcatcatgacattatccagaaatctggctaaaaacaacggttagtgtatctaacattttgagatttatgtaaatggtcaagaacacatgtgattgattcttggacacagaaaatgtttgatttatctttttgactttttgtatcaaacgttgcaagtttggttcctatgaaaatatgggccggatcaggcccggtagacctatatgttgcccatggtagacattccaatctcaaatccaaaccagagacattccaatcgaaacaataatacacttaggccttagcatgatttcgtaaacgtagtccgacctaactttcaccaacaaaacgacggatataaggcattctgtttctagaaagtagaataaaccaaagagggccattcttgtaataccttatttccgaaagatgttgaactaagcctaaccgggctggatataataaggcatcgttatgggttttaaatttacaatttaactaacgaaaaggaaaaagggaataggtcaaaggataaaaagcagcggttaaaactagggttacttaatccacttttcggttttaattacttatttatttccccttgaattggtgtagtcgtatgctagtattactattagatctcattacttatagggaacaaatataaactcgatagtttgatttgatttgaatttatttagattagattataccgtaatgaaaaaacacagtagtatttaaataagaaaaaaaagcacaaaaataacaagcgagcgagttagacaagaagaaagcaacaatacaaatttaaatacaaaataaattatataaaaagagaataaaaatccctaaaactgcgagcgtttttgtttgtgagagagaagaagagagagacgagtctgtatggcaaaagg

SEQ ID NO: 4845 - DNA, 878 bp, Arabidopsis thaliana
acacgtgtcctctctctaagcattgtcaagcatatgtatgtgtttgtaataacgttctccaaaaactctttcgtgcgttgtaatgttctaatatatggttttgtaataaacgtctttggtggcggtacgtatttgatacatattggtttgaaaatgcattcaaatactcttttagttcctaaatttcaacatgtgatagctatgtatgtgtaaatgagcttgttgtattatgtatcagttttattccgctttaatttgtataaaacagtaattttttctttgtgttatcaaggattcaagacaaaaagaatgactgtaactatctcaggaactgaaacgtttcttgacttattttccagttgtaagaaattcttggatgtaatttggccatgcaaccaatcacacaaagacacatgaaatgaatgacttggggacttaatctagattaatctaaattttatgagttttgtccaggtgttgtagtttggttggtgactatagttgagattaagttatgcatatgtaatctcaaatctaaagtagattagtgtaggccatttttacgcaccacactttatgcattttctcatcttcccacttgtcgctatgattcaaaaaacctggcacatcgggaaaaaacaattaatcacgtgtactcaacctcacaccaagcaaaatctcttcatccactaataaaaatccacgtcagagatatcttacacgtggacggtcacgatccctcaatgacattcaaagaggattcgtctccatatataaacacagagagatagcgagggacacagattcgccgcagctagagagaaaacgaaactaaccggagcatgaagagacgaagatcggcgaagaaatctccggcg

SEQ ID NO: 4846 - DNA, 1289 bp, Arabidopsis thaliana
ctttgaatcaaaccttctgattccttgagagtcttctcttgccttctcttcttattcatgaaactcgaagacaaactctcacaagtacattattgttggggtcactagccatctaggatccatcggatccgccgctaatctctttgcaagtatatagtgaccccaagtcaacttccgccgcagatagaagccttttacaccaaccgtcgagccgcaagatgacaattcctcacttcataactatcatttataagttttgactttgaaagaaactgactttaaaatgaaaatttcattagtttaagtgaaacagcatttgaagggcaaaaaatagtcccctaaatgtttgatgtaatttaattgcttgtccatatgaaaactgtgaaatagaaaaaaaatcaagttaaatttcaaaaaaattataaattcttactgagacttaaaatcatcagtgttgaatgattaattataaattttgtaagtatagactcatattatctgcataagaaataaagttatcacaaaaagaggtttataaatcaatcgtaaagttttattgcatcatctggttcgggtttctttgtattagatcatgtttaaattttctcttgtacagactaaattccagccaagacatctcctaaaatctcactcacaagatcttgatcgttcacatttacaggctcatacttctcatttcttagacaatggatttggtagagggacatgaatggcttgctcttcttgtctcttcggttcctcctttgtaaggggttctccaagcagatattggtccaacgttcacctaaacggtgacgcgtatgcaggatattcaaaactcaaacccacaatccaatgacctaatcttgcttgagaggtaaatttcaacagtttgagtatctttaaacccatacaagaaatagtaaaagtgatacttgtagaggtaaaaatggttaagaaagaattgttagatacgagaaatgtccattcgtatcctgaaaagctctttcaacatttttattcaagtattcgtcatgtttgctacgtgtaaactaaatcactttttttttttttttgtgtgtgtgtgagagagatttaataacttttattaagagacaaactaaacaacatccttcttagtcactactctctctctctctctatatatatatatatatatatatatctagtctctacagatattttggacgagaagattcatcaaaaagaaaaaaaaaataataaaggaccattttagggaagtgagaacaaaaacaaaagtggtagct

SEQ ID NO: 4847 - DNA, 2000 bp, Arabidopsis thaliana
aaagctcaaacaatgtggtaaaggtgtcatagttgcaacttacaatgaaaatattttaatacattaaaaaagaaatccactttatttgaatatagaaagtgaaatcaaaatgttttgttatataaaatatatgtagaaaatcaattttttattagccaatttcgcatttgcactcctcaaatcctctagtgcgattcttttattgccttttctaaaagccttgaaaagttaactttttactagaaaaattcccatgtgtttgtatgctatagctttattttctatttatgctaataaaattgacatccttttcgcatttaaccagattacaaagcgaaatgtaatccatattgtgggaaaaaggtatacaagattccaacaaattaagaaatttcattattataatagtttttggtctcgatatttgggaaatcataatgaaattcataagtttttcaaatgtataatagccttccaataatagcaaccaaaatgtggggacaattctgctatcacccaaccactcaacggtgatgggcttttacatcacggcccaatattaacctcccacgtaacctttttccattacgccctgacgcacaaaacaccacttccacttggcatctagttttgtcacttgcttcgaaattgccacatgtacggatagtatatcgccacgtatacgaatgctttggtttaccttattaattctactatttcgctttctcaaggcgttgacttcttaaccctctatatctctattccataagttcgtgtcttaacaaattgtttagattaacatatctcaagtcttaacaaaataacatatgaaggatatgtataagataacactaagctggataattttccttaagatcacaagagatcattgagaggattttgttaagcgtatcttaaaaaaaacagagctgtttgaatcatcacgaatatagtatttgattatacacacattatttatatgcaaatacattatactaaaacgataaaaatgaaagaaaaaaacaaaaacattatggggggcgactataacgaagtctgctaaacattttgcttacctatctataaaaaaaaagcaagaaaaagattatacacaatgaaagaaacaaacagaaggatcaaataatgatctaaggcacgcattgtttaatagaccacgtaatttgtttaagcaacattttttattggcttttagcttttgatcatttagccgttgacctgttaatttggtcgacatctaaaattttgttttgtaaataaagattaagctcaattattaattcatttataatatttagatgagtttgtttgtttattgggttgcggaaaatgatcacgaaatctaaaatgtgggccattctttatgttttctaagataagaaaattaggtatctttatttaattttaaaacaggtaagtttggtagaaaacttcaatttaaaagattgaatatattactaaaaatgggtaatcgcatttattaatcaggtattcacttttcaatctctgagatgttgatgaactatataacatacaaggattaattatatgtattgacaatgaattatttttctcttgcgagaaaacgtataattcttggtctcttccgaagaaggtacacatcataaatatcgatgaagagacaaaccaaatttaacggtttgcaagttcaccaccttgttcctgtccttgttgttcatgtttttgagagatgccacgtgtcaaatgggcctatattcaacaataatattgacggcccaacagtctcgtgggcccataaaggtaagttggtgctgactgtatctgtacgtatgtctgtatataaatatgctaatatgtgactgaaccatgagagaaaaaaagcttaaattctttagcatcttgctttaataacctcgaggaagcaaaacgacatagtttttgatagagacatagaacaacaatattctctttcttttctctgttctttgatcctccgatca

SEQ ID NO: 4848 - DNA, 2000 bp, Arabidopsis thaliana
cattttcccaattctcctttaacactagaccacagttgtgtgggcggtttttgtttttcaaaatctcattttcataccaaattgttaataatactcaagaacaccttataagctagatagattacaatctaaagttgcatgataaaagtggagaagaatcggctgataaaagtggagaagaaacggccttagactgaaactgaaactatagttcaaagtttttctataattaattaggaaacaaattttatagtaatcttccagtcatgatgttagatttttatttatcctattatttaggaaatctagttctacttcatctacgttattttttctcaaaaagcaaaactttttttttaaaaacaaaaatttaataacaaaaactaaaactaaaatctaaaatcgaaaaactaaaaaccaaattcagaaactaaattaaaaaaacagcatccatttcatggccaaaacattagatattaatgcttctaactgtctatgaagagtgagatataccatgaagaggttcaaagttaatagaggatgggtgaagtctctggtttggatctcgtctttagatggccttattatgactttaagtcatctttgtacagtttttagtatcaaatgatcttaaaatctatttcttagctttactttcaccaatctaatgtgatattccccatctagtccctcgaaatagtttttcatgccgaatttttcatatatagtatatcacattatccaaagaaaaactttcgaaccaaccctaaaagcatctataccaaaacagattccccatgagccatgagaaactatgttgaccaaatctatgggttcttaatattaatttaagattctgattttccctaatttgtgaaatcaacgtcttctgcccataaatcgaacctcgaaatcgacaatactattatatataattaaatcgttatggttccactttacggtgaagttaggcgaaaaaagaagtagttaagtgtcataaactcaagtatgaacagaaggggagtacatattcaggggagtaattaactaattaagtgttataaactcatcatgaggatttgtgaaagtgttttccagaacatgcatgtgtgcatatagaaaatctaaaaaacatataagtccacgtacgatattaataagtttaatttaaatgttacacaattaatcaaaacatattcatttgttttcaagctcaaaaacgttttggttaaatgtaagcctgtatataaaaaaaaaacacaacttgtaaattaatttgatatccaagcattataaatccatgttttttaagaaatagtttctttctatatcgcttgaatcgacgttattttaaaattaatgcatgcgtgtaagtgtagctaaatacttttaaaaggcgaaaataagaactgataaacatttttctataatgcctcataggccactagttataaactagtaatttccatatgtgaaagacccagaactgtgtgtataaataagaatcgtcagccatggcttcttcaccaatcaccacagcacagcgatcatggttatcatctatatatttctttttctctcctcagccattataggtaactaagctctccttatccacacttttttatttacaccactgatgtttaatactaaggagatcagcttccttatgatccactatttacacacgccaatagtcttattccctcttcttcactaaaatatatataacactatcacataatgttataatgagataataattacatatgaacataacactatatatatagtaagttttgaatatggtatgaatttattttgtttgttttttggcaacatcaaatataggtttgttataaattttgcataaaatttccaggcaagccattccttctcttttaaaaacaattggtggtgtcttggtatataatatttattttcgagacagaaagtatattgaatataattagaaaacacaataccctaatttaaatttt

SEQ ID NO: 4849 - DNA, 2000 bp, Arabidopsis thaliana
ggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaatt

SEQ ID NO: 4850 - DNA, 979 bp, Arabidopsis thaliana
tgctaagttatttttagtttacctagtttatatcaatgatacttttcagtataaataaacgaattcgagtcaaagactatctaaactattcatattaattgtgtttttaatgttttaccaaaattaacatatgtatatattttttggtcaacgttcaagtgtatatatagggaaatatggatacatggcttttagtttcccatatgtaaacataacataccaaaaaagtttcaaagttattcaaaatactttcatacgtatctttcaataaagagattcctaaaataactttaaaatagtcaaaataaccaccaaagtttatgaaaatctaaaaatattattttttaatttaaatatctttgtcacattttctatttacttcttatgccaattattgtttaagataatgatttagattaaaatattaacgaaatatcattgcttaaagtgttaattttactgtttttcgagtatacatatattcaaaaataaaatcaaaacattaaaaagaaattgaatcaaaaaagggtaatctattcaaaagaaattgaatacaacataaatgaaaaccattgtcattctttttccctggatttcacaattattaaaattaaactttatattaataatatcttaagataatataataaataaaaagtttatgagatggcagttaccccgttgggaacagattttctgatcccgccaatgttatctccacgtgtcaaataaatattggtcgcagagatatgcttcatctaaaccagatatcctcctaaccgtacgataaaaatccaacggaccagaataaaccttatctctccagttttagatctcgtataaattcaaagaacccaaaaccaaacaaaaagcacaagcacttagcagagcaaatgaagaagacgaagcacactgagaattcaccggccagagatcaccaataagtgttgtagtttccggttacttcgaataaccttca

SEQ ID NO: 4851 - DNA, 2000 bp, Arabidopsis thaliana
taatgtacctatttttttaagatttgtttggtgtgtgtgtagataacaaatcacatgtcaattctatcccatttctattttcttcgttattaaatatacaaatatgtcggtaggagttcagagtaaatgtacaccatgaaatctaccaaactcttttaagattgtctttcaggtatcaaacaaactttcaccaataaagctttttcccttttccaaataaagaactccaaacaagaataaaaaccacaatcattattcgatatgtttttatcgatacttatttcaaaatatccccttacctatttacaaaagcatttcacgaatgtttttcttagagtcgtcgtattttcatatatactgatattagcttaattagctcgtgatgacagcaaaattcttgaatattttgtaggccatggtctttgtaacttgtcaagaacatagatacgtcggataaattcatagatatcaattcaaatgataagctagcttacgaaaagcgtttctcaagaaactatgatttttttctaagaattagttggtcgttacgataaataagaaaccttgaattgatggaaaagaagataaggaattaattaagagattggtaaaatggtagttgagaaagtaaaaaggtcacgtgttagggcaaatcattaatggaagaaggagaaagcaggtagaaatgcactctccattttcattacattacaaactccacgtgaggtttcaccgattgtaggaactcctgattttgtgttaattactcacaagtaattatcatatagcgcgtagctaaatattagtataggatgtaggttttacttatataatgctatatctcactactttggtgaagagaaaatggatattaaaatttaaacggttgatacattatctgaatagttcttatatatacgaaacgatttgttgagatatgttttaacacttcttaaaggaagtaggataaagtggaaggtcacgaaccactccccatattgcagccaaatctacaccaaaccgtacccaaaaatgaaattaactttccctcaaaaccaaccttgtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactcactatggcaaatatatactattttccattgtaacataaatgtccataatttgaattaaattcgttgcagtacgaaaccatccaactttgtccaaaaacaaaatccttataactatttactttaatgtaaatatatcctctacttttgtttttacaaccctagctcaaacaaatttattatttgcgatataaaatcatatcgaacaaactcgatgattttttttttcttacgttattaatgaaactaaaatatagaaaaaaacaagatgaaccaaattttcacctatctaactacttaaatataatatgattaaatttggtaaagtttgaaaagtttctttaggaaatgtgaaatattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctttctcaaaccgtctctccataaagccctaatttcttcatcacaagaatcagaagaagaaag

SEQ ID NO: 4852 - DNA, 2000 bp, Arabidopsis thaliana
ataaatggaagaaaaataaattgtaaagcgaaattaaatgtttaccgtatataaacatttacgtgtatagtaaggcacgtatttatcattctcgaaaaggaaaagaatagaagtcaatgggtgcaagtaatgagggtatttatgtcatttaggaaatggattaccccagctcacacggcaagtaagtcgataacgaacaaggctcgtgaccggaccatgactagagtcgatatccaaatccaacgaactgacatataaacgggttttgcgtgaaacaacgaataacacgttcacactaaacttatattttatttttaattgatgtatatggttttcactttttagcttatttaaaattcgctttcatagttttgtttttatgcatttacattgagtttttagagtatttttaccgtcttttgttcttcgtttcaaattagaatcttgtcagtaattgtgaaattagaatcttttcagtaattgaatgtgtgtgcagttgaaaacaaggttatcgatctctagtttgatttaacacaaaacatgagataatgctcaaaagattttgatccatcaatttgatatcctcttattgatcattctattctacaaaaaaagtagttttacttttgttaggacaagaagcacaaaagaccaaatttggttagataacacaaatgatggtttgagcggttcaacaacacaaatttggtacgtaactactctgtttgcttataacaacaatactcttaaatgtaaccaccaatatgctaaagatattgttccacttttcaacaaagtaataataatattgttcgaccaatatactagcactgcaaatgatcaggtgaaaataaataatttttcatctttttcattttaaatggtaaaaattagttgaataattttttgtctaaccaatgtaatggttcgagtacatatatatatgatatatgtaataaagaaacatagaacaatatgtttgtaattaaacttgtacatgtacatatatatatatatatacataatacataatcaaatttcatctcacgaaaaaggtggataatcacaatctcaaatattatgttaataagaattttcggaagatcaacatcaatgatccaattttctcaatcagacattattttcctaaatttgcatcaattttgttctagttgactaattgacccaacaaaaaaaaacaatattattcgattcaatagaagtgtatattctaataacattgttttctttttataataatgaaaacaaaacgactttgatcaaattgttatgctgtccactcacacacgcatcatcaataaataaagaaaaaaaaaactcaaacccggtcaaagatatcccaattgctcgttgaccatgataaggacatatccgtcattttaatcttcccacgcttttcctcaagggcttattcgtctttaaacaaaaaaatagacatccactgggcacgtatcttcttcttcttcctcgtctttaatcaaaaccaatttattactctgattgttatttcgcaattcggtataattcaaacgggagatttcgttttccgatcatcaccgatcaacttcttcgccggagaacaaataagtttcaaagcttcttttgacgattaaagtagaataaacagaaattgaatccatgaagaagataaagagaaacctcagagaagaagaagaaggtaattgataaatctaaaacactaattagactctataatatcggccattaatggaggaatcagtttctctctctctctctctgtttctctatgtgtatttattttggtgtgtaccgttgggaagcttgagagcttttaatagctcaaccaatttccaagtggtctctctctctcgaggtcttagggttttagctgttgacttgtcgcagcttcactggagaattgaatgaattttcttatggtttcaggaaggtgatgaatgttgagatcgatttttgatttcaatcaacgttcaacgaag

SEQ ID NO: 4853 - DNA, 2000 bp, Arabidopsis thaliana
aatcacacaattttgatttacaaaattaaaaaaccaacatcaatatgtttagataaacttaataatctatctaactaaaatatagatagtaaaaagacaataatgtcaaaattaatcgtatcatgtattttcaatgtaaagtatactaaatgtagaaatataatgtcaaatttagttttctaaataaattgggaaaaataaatattactagtgaagatagtaattttttcaattttcatattaaaatggtcattttgttaggcttaagatttccttaaatggcgttattgaccaaaaacggaaactgatgtactttagggtccacattcacgaggaatcctacctggcttatagtcacatgagcccgcaacttgtagccacgtcatcttaagtcaaatatggtacaaatttaaaatagagtagtactaatttttttcttttggacaataatatttgatgtcatggaagatacttttgatttgtatttttaagaaaattattgactacaatagtaaagattgcattctctttctcagacaataatcaatctcacatcgtttaacaggattaaaatggtgaaaagatagtcatttacacagtttcatcatgttctttagtctgttcttttcatgacatgtaatttccaatgctaattaacagatgatagtaaaataaattacaatacaaatatgttaaaatttgacaaaatggtaaatcatttgtttatatttttataaatccaataccaaaatgatttgaagttgaaacgttttgagtgtgaccctttaaattttattcaagggttcttattctccaaattaccattttcaccagaatccaggctctgtcattattattttagttgagaaaacgacttttatcctatttactcgtcactgaccggtggtgtaatttactcctttttgtaataaaaataaataaatcatctttctgatatgaaaaaccaatatttcaagtatattttttagtatataatcaagttttacaaataaatcataaaaatacgcattcaaagctacaaattctcgttctatctactttttcatagatcacttttcctagcccattatcttttgttagatatcttcacgtcaatttaaaaatcctaaaatatctatttttgttttaaatgatcataggttaacaaaaaagttcgtcaatataacatgcactaaaacgaaccactaaggtatataagtcatagttgaaaatagttaagttttaatggacaatctattccagtactgaatataaaacatgatagagcttttaaaatgttaacatccttcatttttattgtgcgaaaacatccataatctaaaatataaatcgtatattgtagaattcaaatgtcacacctagtgataagaacattgatcttttggcgcggatcaatatatagaataaagaatttaagatgtttccgcaggcatcaacgcaagtttaactgctggaatttctaaaagagttcaacgttcaaatgagaagttgtaacgttcaatttaagagtttcaacgttaattacatgaaaggtttgttgtaacgttcaatgaagtcacagaagaaggaagcaaaaagcttctcaaaaaacttctattgcatttcatttttttatttatatgtaaaatataatttaatttcctagttgaaaattgataaatctattttttacaagtaatggttaagtggtgatgttctaaatctatgtggcatgaggtgtaaaattgtacattatttttttatataagcaaaaaaggttctttcatgtgcaatactcatcatcatggttctttatagaaattaattttttttttaatttatatttagtaaaacaatttttttattgtaaaccatttgcttctactataaatacccctcctcttgatcaaatctcttcactcatcaaaacatcacatacactatttttctcctctccttattgtctatatatttttcctctttagctttttcatttcgaa

SEQ ID NO: 4854 - DNA, 2000 bp, Arabidopsis thaliana
atttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtaggccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatcat

SEQ ID NO: 4855 - DNA, 383 bp, Arabidopsis thaliana
gcttagacttttgtactaaatgctaatttgtgttttttgagtaacggttacttttgtactacttttgttattatgtaaaaagaggaaataatttcgaggtgatacatccaaataatatattaatacacttatattttacttttaagaaagaaaatcttgagaagaaatctagaattataatttcgtctgcttttttaaaaggtttttcttaattagagtccaacgttcgaatttgaacttgtgacaatagtacattatcttttatagagcataatttttaaaaataatatatttccttgaccacatgtatatatctccaaaacaatagtaaaaaaaagagagacgaaaagaaagaaagagagagagccccacaaacaaacaaa

SEQ ID NO: 4856 - DNA, 2000 bp, Arabidopsis thaliana
attttttattgcgatgaactgataatcagcaatatcaatgaatcaagaaccggatcaaaatatttgtctccaatagtttttgttatgtggttgcaatggcaaggttgatcatcctttttcaagtcaacgttgatcatcctttttcaagtcaaggttgatcatcctttttcaaatcatctttggttctctctcgagattgttattttatcttgttccaattaaagttttgatagtgaatgttagtggcaaaattttattcaaatattttataattatttttttgtagcaaatcaattttaagttaaattcgatttaaaatgattttttcaacaaatttcattaaaaaaatttatagatacaatcgcaaagttgtataaaattttatttaaaaaagaaatttttgtagaattattcaaatatgaatgtttttcattaagatgtccattcaaaataatataagaatataataattttaagtacactcttaaaacgataaaaaaaaaaaaaacaattaaaacaggattttttttatttttcttgaaaattgatgtcacgcatgctaaagatgcatgcatatgggacatgactttacttttgagagccgaaaaaaatggtgaagagctggtattgttgggttccacatcgcggtttcacattacacaattggaaacagttgaatatcccttagaacttaaaacaacccaagttaaaaacaacaacccactaagtttatataaaagtaaatattcgtaagaaaaaaccacggaactacactaaaaagaaacattaatacaaaatttagttttttttttctgtcaagtactgtttatttatttctttttctatttcagtaccacattgacatacctacaaagtatgatactcgtttttttttgtcaaaacaaattacaatattcgattattaaattaaactaatttgtgggctggtcgtagagacatcttctatcttcttgcgaatatcatgataatcaaatcttgaaaacttaatttttgtatgtatgaggaataataaaacacgttgttttatggtttaaaaaaaaaaaagctaaaaaaaaaataaagaaaataaaacacgttgttttatggtcaaaaataccaccttgtcaccacaataaacaatgtgaacaaatttatgtcggtgcgcatcatttcttctgatttcttatgatttctttccattttttatgtgttacaaaattattgttttgaacaaattttcacacctgtggtctgtagatatgatttaaatatactaaattatccaatttaattataattgtttatgcaaaaaatttgatcatccgctttctgcattagctcttcaacacattattgtgatttctgaagtagggagcatatggatatgtaattatgtaccaccaaaaaaaaaatgcgcgattgaaaaatgaatgacacatgtgacatgtgttggatcttctgataaaactccaacgctaaaatcaacaccaatgtgatttttttgacgtaaaaaggacaatgatcaaaagcgttaagatgtgattgtttatgtattttaggtcagtttttttttatattatattttactccgaattccttattgtgaagcatagaatgcttatagtttatcataacgagattcgaatacgagatcacaaatcttgttttaaaacatttgaaaattggagaaattagtggctcacacatgacggagaaagatgaaccgcatgcctcccattaccaacgtgtatggtatcaatgtcctaaagtgaaattattatattcaaatgtcataattgaacgtgattcatggcattggcatctatatttatttaaatatttaaaacctcattgcccagtggccggcaaaaaagttgataaatcgtcgtcgtttgcaaaaacgacatttaacccttgggctataaatagaaagtgagccaattcagaattctaaacaaccatctatctaagaagaagcagaaagaaagaagatctaacta

SEQ ID NO: 4857 - DNA, 2000 bp, Arabidopsis thaliana
tatgacggaataattatagttttcttagaaaaacataataatttcgttttatttgttcttcaaaagttagcgtttatactgattagatcgtagttttggtgaattacataaatgtattttaaccaactttttaaaattatcaccaactacattgaaaatcaatgttcaaccatcattatagtttggtgaactaatattttaatgtgctaacgacattataaaaaaaaacagcagacgatttttcttttatttaagcatttttagtgtcttttatataacaggcttttggtcaaatagaataacactaacttgatgaaatatttgataaaaggaataaaactaaattattatgactttgttatattccacttgtgtccggtggctttggatgattgtgtagctgtgaattagaattacacaactactctgaattagtcttcgttagtggagttttctgcatgtgagctagatttgaatacaatcatatcgaaaatataaagaatgatcaaaagtagtttctttttccaaatagtgatcagaaactagaattaaaattatctgtaatccatatcaatatgcgtagaaatttgatagtcaacgtcgtaatatctctcaaaagagttggagtcgatatcatacttttgaaggcttgaagcagcccatgccatgtatcgacacggaatttcagatagataatttaccggtttattccggtttacagactcaattatggttaacacttaacaatatactctaataaagcttttacccctaattcacctgtagttttttcagttaaagctaatgaaacgactaacgagtgcccaactcttctaaatatgtgatccttcattattccgactagatatatcagttgattgctcattcattattaagtgcatggcacttgataccaaaaatgatattcatggtttagtgtaggattcaaaatttgcatatttgaacatagtgttgtattaattttctttgactcaaaattcaacgaattcatttttcatccaaaattaaatgcattccaactttttaattttgtcaacaaatacattcaagtattcaacttacattaattactgctttgcttataaagagttacctttttgggacctttaaatttaacttcataataaaattaaaaaaatatatatacataaaaaacacaaaagataaagtaaagttagatagacacagtacaagtaaagaagaagcagatttctcccctttccaagaaattagggtttttggcttcgatcgaatttgcggcaagtaggttcaatttcttccgacaacagtcatcttcttcctcatttgtctctccgagtttcgaagcagtaagctctttactttactcatttttgttgtcactggaaatttcataatgcattgcaacgaaaatctctggtacagaatttcgacaatgtgggttgttctttttccttgataatcttcttcgtgaagaaaaaaagtattttggaaactaaagttcagatctttgcttgtcgtttgatgagtgagagattgctgggtaggtagattaattctatgagtttccagatttgattttgtgaattggttctgtgtggtgtttatctagtaagctttttgtacaatgtgtaatgtttgtttgatgattgaaagtttgaaactttggtgctattttgattactcaggtgagctaagctaaagaacaaggaacaaaaccaaattatgtgtttgcgagatctgtctcatagtttatggagttggagaggtgtttaagcttggtattgagaagctatactgttgtcagcttgaggtgtttttagcgaaagggtctatcgagtgaatagaagttaaagtatgggttcgctctgttgtgtagctgcgaagtcagatagatcaaattctacaagtggggacttttcatttggcctgcatgagccttattggagactaatacaagtttctctcctccttcatcgagatgggacgtccatggatta

SEQ ID NO: 4858 - DNA, 2000 bp, Arabidopsis thaliana
caataattatttgctggtatgatgttcagtctctgctgctttatctcataacctattcttgagtgaatggagaaaccaaacctgtgaaaaggaaaggtacaagttatagagacagagaagcagactgaaacagtttccaacaaaagaaaagaagcagaaaaccttcaagttgcggttaagtttgagaaaccctaacaaatctggagaaatgatgagtgtgagaaactcactgttcgttgttcgaagccgacgcgggttttgagatgataagtagggtttatcctaaatttacaatgtgcaccctatatgtctcgacatgtttcatttattcccacaaacttatgaaacatctaacattaacctcctctgtttttattccctttgtttttgtgaatcggtttaattattttgggccaattcagctatcggattgggctttttcaagttttgggttgagttacaaccaaattaaaaatcaaacagagatcaatttctccgcatagaaaaataacatgttacattaccattcgaaaacaagatgaatagtcatttatacacgcctctcttacacattataatgtctaaataattgcattatcatattcaaaatttagatatgttggtcaaaaacagaattaagtattataaattgtgtataccaaattagttgacgctatcattgcatatcatactcacatactacaatatttattacatgaactaagtgattgtattccagtggctattttcatttaactataacaaaaaaatcgaatgcgataaaactacttcgaaaataatcgatggctcttggaatttttataaaatctagttcttgaaataaataaaaatttctatgcaatatttttcggtaaatttttgttctctattacaataaaattttattttaaagaaatgaaattgttatttagcgtatatttgtaaccaaattagcaggcgtaaatacaaatcctttaaataactctgttgttgtgtggatatgcggtaatgtccacccgtgaataaatgtttacgtgttatatgacccaacaaagtgaaccaattatattactcctctctaacgcacttgtttattgcatttttatttatttgatggtcgaaacaaaatagtaagagtagttgttgcataggaaattgcatctgcttgcttttgaagcgttaataacttataaccaagcaagacatatatcatacagagcaaaaaattaggcaaacccagaaaaagccaccacatgttcctcttctcatgatcttaaaattgaaaaaaagaaggtgataagtttaatctaatcttgaccagtgaaatagctttttgttgcttgttgtttttgttcattcttcacagatttaattgtcacatacccaacgtatatggatggacctgtagatttaattccagttttacccttttcttcttcctttcatctgattttgtttgctgctttttttttgttttctggggaatatggaaaaggttaggtttcatatttggacctttttttttggtgttgaatttttcttcttaatttttatgcaaacatggaaaaggacatgcgatgataatcctgaatctactagtgcttagatctgatgaatactggattattaaaaaaaaatattactaaaaatttcaatgatctagggtttcttcagatctttaaatttgttgctgattttactcgatttctcttagtctgggtgcagttgatggagctccagctattttgaccatccaatttcaccagaaaccctaaatcacaagactatgtaagcattttccttatggctcttcttcctgatttttgattcagctaatttggtgatgaaccgtttatatatatctgtaatcgtactttaccctgaaaatatgtacctaccatatgtgtcatgtgtatttttattattttataaatggttgtgatattattgagacatgaatgaatgatgcttcaattgtatgtagtgttggcacagaagta

SEQ ID NO: 4859 - DNA, 760 bp, Arabidopsis thaliana
cgtcgtaagacatagacacacacagttatgtattcccagtgaaagaatgttgtttatttctctagatattagtatgcttataaataggcatgaaggagaaagacaattttggtatagtggagttcagcagaaaatgtatatgttttttcgttttatatgaatcagagaataaaagttggatgttatatctacgttgctaatgttgtacctgctcacccatctttcatataagaaaagagaacacttttagttatccctgtgatgcagaatcgtattctttgttatctctccattcctgtggaaaccaacaaagtcaactaaatttcggtttaattggttggtttttaagtcaacgaggacttgattttagttgggcttgggcctataattgtgttcatcattgggttttttcccccttatcagtttaacgtccatatccatatctttttctttttttaacggcaaagttcatatccatatcttatgatgtgcctaaaagagggagaagatgcgaagacagaattttcatatttgaaagggttcgatatcgatattgggaaacgaatcaaggtcaaaaaactcagtctaatagttgaaatttaaaaattttattaattcaatccgattggtttcgttttgttatggttcggttctatatcatcaaaccaatcggtttggtcctaaagataattataaatattcaccaacaccagtgttaaacacatatcaacaaacctaaagttagataaacaaagagaaa

SEQ ID NO: 4860 - DNA, 2000 bp, Arabidopsis thaliana
gaaatacataccaaatcacaaacccgagctcatttctattttatttgttcttcattttgaatgtacactgatgtttgtccccaaaaaaaatgtacactgataaaataatttaatagaatgattcaggatgtcaacgcgtcatcaaaagttcaagactactggaccaaatggtccaacaccaaccttatcgtaatttatctataggtgtgttttcaaatggataaaagattaaaagacatacatgatccagatagatgaaagcaaatgataagacttaatataaataataaagaatcgtactgattttttgtttgtaatgtgaaatagaatggctcgcaactcaaagtgtcagactctatctatgcaaaaaatgtcaaagacacgcagcttgtttatataccattcatattgccaaacttttggaccaaaatatttttattaagatcatataaacacaaagagccaacccactgtgatcggtgtgataaaatcccaactacttggagcaacatgtagtttacattattaagctgaaactctaaagatcatggaaatatatcaatcatatcactgtagggtaagtccaaaaatagaggtacgtacgaactacgaagacaacataacgttttagtttctaccaaactttattgactaagtacttttttttttaattgactaagtacttcatatagaagtgcaccgattattgcaaacccttattaatggacggcaaagaagagaaaatgacgacagcttccagcttcctaactcctaattgcatatatggactatggtaggtgtccttctcgtcagatcacatgtttgggaagattaatcattggataaacttaaaagaattgaattatgattagaagttatctgaacatttacttttgaaaataatatattacctaacaaactagtattattttggctaacgtcctatagattgtgtttcgaatagttttggaccttttggtaatagaaaaccaagtaaatgaagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 4861 - DNA, 2000 bp, Arabidopsis thaliana
tgccgcaaattcgatcgaagccaaaaaccctaatttcttggaaaggggagaaatctgcttcttctttacttgtactgtgtctatctaactttactttatcttttgtgttttttatgtatatatatttttttaattttattatgaagttaaatttaaaggtcccaaaaaggtaactctttataagcaaagcagtaattaatgtaagttgaatacttgaatgtatttgttgacaaaattaaaaagttggaatgcatttaattttggatgaaaaatgaattcgttgaattttgagtcaaagaaaattaatacaacactatgttcaaatatgcaaattttgaatcctacactaaaccatgaatatcatttttggtatcaagtgccatgcacttaataatgaatgagcaatcaactgatatatctagtcggaataatgaaggatcacatatttagaagagttgggcactcgttagtcgtttcattagctttaactgaaaaaactacaggtgaattaggggtaaaagctttattagagtatattgttaagtgttaaccataattgagtctgtaaaccggaataaaccggtaaattatctatctgaaattccgtgtcgatacatggcatgggctgcttcaagccttcaaaagtatgatatcgactccaactcttttgagagatattacgacgttgactatcaaatttctacgcatattgatatggattacagataattttaattctagtttctgatcactatttggaaaaagaaactacttttgatcattctttatattttcgatatgattgtattcaaatctagctcacatgcagaaaactccactaacgaagactaattcagagtagttgtgtaattctaattcacagctacacaatcatccaaagccaccggacacaagtggaatataacaaagtcataataatttagttttattccttttatcaaatatttcatcaagttagtgttattctatttgaccaaaagcctgttatataaaagacactaaaaatgcttaaataaaagaaaaatcgtctgctgtttttttttataatgtcgttagcacattaaaatattagttcaccaaactataatgatggttgaacattgattttcaatgtagttggtgataattttaaaaagttggttaaaatacatttatgtaattcaccaaaactacgatctaatcagtataaacgctaacttttgaagaacaaataaaacgaaattattatgtttttctaagaaaactataattattccgtcataaaatattttaatttcaggtacatatatatgtatttaaatatatatttttaagtagtagtttacgtgccgtcacgtcccgaagaacagttaaaagagaaaaagccacctgtaatcagatatttatatttaatatatagacgttagccccaaaaactttgtatttctctgctttcaaacccaagaagccaaaataaaaccattgaagctagcagcagccgaagaagcggtcacattttccggcaaaacagacagatcgaccagtgaaagctcctatctgtaagcattgcatgttcccaagctctaattcaatgaaatgttgtagattcaacaagtcatgtaaaatgtttccttaataagtcggtgatgtctcatggatcttgatcggttgtgtttgtgtagttttcttgtctcaattttgcataaagagctagaattgaggggagagatttgacctaatccctgtttcttgaataatcttgtttcttgatttagcatagttgaccaaacaagtcaaaggtgtttatgtctgaaaatttggctctttgattttaactaatgtagtgccaagatctgatctttagaattctcaaggactctgttttgtgtgtttctttagtgtttgttgattatatataaaggatcatatgaacaaactaagctctaaattatttttcatattttctccagcttcctgaggcattgtgatctcttgttaaa

SEQ ID NO: 4862 - DNA, 1876 bp, Arabidopsis thaliana
ttctccgaaaacactaatgatcggaatgtgaagaagcggaggagagggagagagaagttgattagaagaagaagaagaagaaggtaaaggactagcgggagattttagaagctttggaattggaacggtttatttcgattttcccgggagatttcttgtggcgggtgatgccaaattttttgtaagggacaaaattggaaaaccatatattgttatggaaccgttcgattttaagatttttgcgattagctattttggaccgtctggtttcggctggttcgttggtttctttatctggataactttagtcaaaatttcggttcaatttaaactatggtttttttttatcttgataactttggtagaaatttatgtaatttgggtttaactactttgtactgtctggtttgataaatcattcttacactacagtttctgaaactgcagttagttctactggttaaggtgctgagagtaagaaaaccagttcatgggttcgatcattccttgcaaaatttttgatttttgttttcttcaacaaggctttcttttgttttttttggcttgcgcttttgtgccttgtgtgcttgtggcaatcaaaagcctaactaaagggcttaatttgagtcaggtttggttcaatcatatacaagttcacaatttgcatcagccgagctctgttgcagttttttttcttctttcgaacacgccaatcatattaatgcattactcttatgaatatgttcagtataacactactcgttaattttttttatttttttttattttttttcggacactactcgttaattaagaatccaaaaactaacattaagaacaaaacaacaagccattgtcataaacactatcaattgaaattaggctaatatcagatctcagcgttttctgtttagtgtctgcaactcctatttcggagattttaagatagataacgcagtttaatatgacatcatcgatctgattctatccatcaaccaatccagatttaaaacaactgattgaaaaacattggataattgattgaaaaacattggatctcaggtttttcatgatttgtcttcaaatccttataggagatttgcagaaagataacgcagtattttaactaatcaatcatcgatccaatcctaacagtctaacacgaagcaaaatcgagcaaagaagacaaaaaaagtaatgagcatctcagacatcgaaaaccccatttgtttcttcactagcaatcaaagtgcaaggataacaattttttcatggattcatcaccgatgctctcttatcaaaacataaaccaaaagaaaacaagatcgaataagaaaatctatcaaaaccctagcttaatcagacaaatcgacgaacagattctaagattcaatggctcgagaaaattatttatataagccgccgaagacaaaaccctactcttctgtttggtaacagatatatcctttgagacgcaaactacctgccgttttctaaaaacaactacgcaccgttttgtctaaaacaaagtcgttttttagaccaccgagaatagtctctcatctttgtcgtgtaacctgaacctccacgtaacgaaagaatgctctgaaccacaaaaaccagaaacgtgtcaaactgcttctgtaaatttagtcataaagcaaataattaaccatgacgcgtctctgatttttcaaacaaaaaaagccaaaaattcgatttgagtttatcatatcttcttctataaataaattgaaatatttttatacacatacgttgtcaaatgctaaccacacgtttgcgtttagtaaccgaaagaaccaaactgataaatactacttctcctatgagaatagtttttggtaaaacttacata

SEQ ID NO: 4863 - DNA, 629 bp, Arabidopsis thaliana
tcaagaatgagtgagatcttaaagatcaaatccaaattcttcctctattcctgcgtttggtttgtgcatattacatacgcggaaaaactgtatgttatatatctcttgactcctttttaacccaagagaaaaagcttatcagaatctcttgttactgcattattggggtttattcaaagttgaagacacaaggtttttgctcgaataatttggcattcttttgctccatggaacttgaccttctcttctgtttgttgacttctaaaactccatcggcccttgtggcattgttaatgtatgtatgaatataatctgatacaccaaccaatcattaagatttgggtttgaaatctgtctcttccgtggatgagatatgctacatgtcacaagaactggtcttagctttggtagataagacttgtcttagagcaagtcttgaaatctggaaatctattttgcagtaatcttgtcacaacaaccataacctaatcagtcagtaccctccaagaacattaaagttagatgatccgacaaaacctctcaacaagaccaaactctttccatataaatactctttaacactgacacaaagtttcatcactttctcttgatcactcactgcatcaaca

SEQ ID NO: 4864 - DNA, 253 bp, Arabidopsis thaliana
actgcttcaaactatgtgagttagtacgaaacgacagatgattttctatggtttggtttgatttgatttagttttcacttttcatcaagaaagaactcaattcctctctgtttaatacacaatgactttgctctgtatatataaacaccagtatgtcccgggcagtgatacttgttaatgtttacggtatttcgctttttttgttgagtgtttttcctaggtgacaattttacatgcaaataaggttaaacac

SEQ ID NO: 4865 - DNA, 1399 bp, Arabidopsis thaliana
ctttgaatcaatcgacgatgtgagagcgtgatcaacatcggctcgccctctctgttataactccatatatatacacaacaaaacttaaaccctagatacttgaggacttacgtgggctggactagaatccatccaattcctagttggattttcgattagctattatcacgtgagtaatatctgcattacatgtattgacttagtattattgttggagcaatgttttttttttgttaaaaattattattggagcaatgttttgtttttgttaaaaattatttgagcaaaccaaaaaatcgcagaatgaattataaaacagttcgtatttcgatgaaatttcgtctctccctctcaatagctttggtgcaaattaatacccttactacatacatgtcaacttaactctaattctaacaaatagaacagaaaatctggagagagaaaaaaaacgtaactagatgaaagaaaagaaaaaaaaaaagacttcaaaatttgtataaaaatatagaaatgttgaacaaaaattattaactctaaaccaaaaattaagacaatgatctaatattctaatatcatgaatcatgatagaaaaggaacacctaactccataaatgatggtcatgcaatgatcaaatttctcctttatcaattattggtttatattccaatgtccaaactcgaaagtcgaaacaatctcctccatatatagccatttctttccctaacccattaaaatacaaaactaaagaaccatcaataattttttcaactgaaaaaggaagaacaatttgtgatccaaaataaaagagagaaaaaaaaaagtggagaaaggagaccaaaagtagaagcgtggtttactccaattgacggtaaacccctttgacaagtagaggcacttgatagtagtgtaacaaaagtacaacgatgggtgaagattggtcaaacatcaaaaggaccccatactcaaaagatagtattctgtttatttataatcatatatttacaaaaaactaacattcagaatataaaaatattagaatatgtaaattttgcaaacatagaggagtattaaatatagttaaatagtttcgaattaaacactaaataattaaatgttgacaagaaaaaaaaacataaaaattaatacggattccgtgcgttacaataacttagcaatattactctctagtagagatgagaacttgagtacttgactaataatttcaacgcatgttgtcttcttgcgaaatagtcccacgctattctaaaggtgggctagtggaaagagtgtagaacccacttttcaaaagcacatcaactactatataaattaatgaaccacctaacaaacaaacccacacattaaactaaagaagagagaactttagaggttagagag

SEQ ID NO: 4866 - DNA, 2000 bp, Arabidopsis thaliana
actttatattgaaatccctagttatataaaaaccatattattaatatattatatcatttgatgcgttttcctctgacgaagaattaaaatgtacatgtttgattcacttcaatactcctgtgattttatccaaatatgaacctccatccaggagcggatctaggtgtatggaagatgggacacgtgccctacactaaattataaatattagcttgtaaatatatggagtttaaatgattcagcacaaatggttaagtgttttcaatattcgtctttctttacacaggtccgaaactagttgaagtaacttttttctttttttaacttttttttttcttccccacttttatcaattaaatcacttgtatttcttcttttcatttatgaacattcacttttaactttcttttaaattttctttattaattgattaaatagtatgtctgctgatatatttctaaaatgtttgatatatatatatacgtttacttttatgtaaaaatgaataacaaaattatatgtacacaatttcatagtttttccttggatacctatataaattgtgagaaataaattacagatttgttgaactacatattctatcacaaatttatagtttagtaacgaatagtatatgtaataattttgataaaacaataatatataataagtaaattaatagtgccttaaactaaatgtttttctagataagcagctgcctccatcaaagagtttttacatggggttctaacttctaaacaatcctgtttaaagaatatgttgagaatttacataccacttttgagaattctatggatggagatgtgaaactcgttccatatctggtatatccgtcacgtgaagctcatgatttttggataatcgatatgtgtagggcccaccactatatttgacattcatatggttagtagtaaactccttccttctccaacgaccaaaacatcaattccacgaggcattttggcaggtgaagtgtaccaatattttcatttgtaaccaaatttgtttaatatatattttcacccttttcaaataagtagactaaatatcaaaaagatttttgatgattaaacatcttatacttttgcttatctcattctattgttttgaacatcaatgtaattctgtttattttgatgattaagtaaaacaattatgtacttatggtttcaaattaatatatcgaaacagattttttaaacacttactcgactataagaattcgacacatattttaccaaaacaaaatcgacatatttttaaaagtatctgacacccctaatatcatataatttcaaatttacacattgtataacgatatgagatttacataaaatattttcatatatttgttcattttaagagttcacaccacggataaattatcgatatataggaaagacttggctataactacaaaaagctgaagggacatttattattatcccccaaaaaaagcaacatcatgttcgtattgattattgaatatgacatattgtagagacgaatcatttatgaagataaatcaaacgacctaccaaaataagatatactcaaaagagatataatgtaagttcaatcagttaaagctactattatggctctgttagatatgagagtagtgctaagataaagagactaccaattcatattaccgagaaaaaaaaaaactgtcttgttagtttagagtacatatataacacgaggatttttggcaggtcaccaacaaaataattttaaaatatattatgaatgaattattatacatgattattatcttttatgtacattttttgaaagttagccctacaaaattcaaaatatggtgacactcctcactagagaccaagttggtccaactctagctataccttccacactgcttcctcccccaccacaaaaggggtactatcgtcatttcacacgtacctacctgtaattaatgtgacattataaataacaacgtgaaagaaggatcc

SEQ ID NO: 4867 - DNA, 1605 bp, Arabidopsis thaliana
acaatacatgaacacttgttcttgttggaaattttcaatttctagtcatggatgtttctgtgttgattgtatagagagctgagaatgtctttgagtttatgtgttgagtataatcttttttttgtcgacattttgtgttgagtataatcttaagaatcgttaagtcgtcatagagcaattctcaaaaagtcaacagaaaatttaattattcggattaaaaaaaaaaaacttaatttagaagacactcgaagcatggggaagaaagatacaaagagactcttcttcttttcatcttttgtattgtggtaatcggaaaatttaaagtggaaacgtgattttagttaggatcattagggttagagttaaatgtgggattttatttttgatttagaactatcacaaccaaaccgttaggattcctacaaaaaaaaaaaccaaaccgttaggattgaggaaaaggttaaccaaatagttgaacatagattttggtttggttttgatcggtttaaattcggttttggttccgtttgcttagactttagttaccgcagatattataatggtttgacattaacaaagttgtcaacacaaacaaggagcgtgccttgcacaatctgctcataattgttattaaagaaaaagggcattgcttttctcataatttcatggcgtgtcagaatgaagatacaaattctatgtatggttttgagggatattactgaaacttttttacttattacaagtttatcaattactccatattaagcattgtgtgcggagttccattctcatttaattttgttttctatcgattcaaatgtctatcaagtataaaccaacaatcacaatctaacccataaaacagtctaaaacctccatttactaagttagaaaaaaactcctatataaaagtaacatattatgaagagaaaaaaaatgatgagtcttataacagttaatggtgaatactacaattgtctaaactaattttattgtcaatttatttttctttttataatttatttatatggttcatttacatgtactacaattattcttatatatttttcattatgatgctctcactaactttcatcagttcatgtaacaacgtgcaaaccacatctccactttcagtatttggattccactttcatgtttcgacgatccatatttgtattattgttggcaatccacatttacttttttcactagataaatccataatcacatatttatacaattaatcattttagtatacaattaattaaggttaattaaacttgctattgttatttatatttcattctcactgaagaactcttcgttgatgattttccactcttgtaagaagtacatcatgctaacaagtataaatgaaatgaacaaggtaggcctggtgcagttaaccaaaaatcgaataattttatcaaaagcctatactaaaacaaatgaatcttctttaatattgcgttatattcttcaagcccatcattatataaacctttatcgtgcaccttttaccgtcatcatttcaaaagcaattcttcttgtcttggctcaatttatatacaacactctctctctctcggttttgtccataca

SEQ ID NO: 4868 - DNA, 2000 bp, Arabidopsis thaliana
ccgctattttaagttttagacaataacttggtccatgaaattaaggtacaacgtcgatattgattaagatcagtttacttttgctaatataacgtgttaagtttgagatgggagacacgtgaatgacttttcattactttcaaaaattgttcaaaattccaaaattggcaacaagactgttttagttgttaatatgcaattagactgtttcaatagagtgtatttttctttgtcaaaatgtaataagtactaatttgtcatacaaaatatcaaatgtcaagaacataaactcttctaacggaaccgcttgtcgcgccgaaactcgtgtggtaaacctgaaaaacaactcactaatcgcaattttaaatcagagactgagaaaacacttctcacgaaaaccacaaaacgcggtcaatatcgggatgacgacatgatgtggtggtcggattgacacaattcaggttggtcaacaaaattcatccctctaaaatatattttcttagttcgttgccaaacagatatcttacctttactcttttttttttttttttaaaaactcatataaataggatagttattaaatttaactacaaatggtattgtatatgtatattctatggctaggtgaaaaggcttcctttagttcgagaaggtcaaaatggatggctaattaacttttatatacaaacagtatatgcctaacatttaataaggagagactcagattccttgtcaactactcactattgtctccatgactctttaaaaaatatatttttatagaatcttagtattcagaaattaaaccgtagcctttataggataacaaatgtagatgatgttaaatatgaaaattggctccacaactgtccatgaggcataaataactcgaaaacttaattagtttgatcttacagataactaattttttgtcacatttattataccccaaagtatcttaataatgcttgtcggttcaagttcatattttttcctcggttcaaaatccaggctatttatccgttcttttttaattaccttcatgataacttgtcaattttgtatttcttattcatgatttttctcatgcacatacctaatttacgtcgattaagatccatgcaacgttcataaaataatgagatagtatattagtattagtatcacatacataacgatataatattttacaatgtatttgcatgtaaagcattttcaacaactactacttaatccactttggttctgtgcaccatatcgaccttgagccgcccatataccgcgactagggtcgtccactacgaatataaaaatttatcgttataaatataaataattgatatatttcaatgattgatggattaattaatataaataaaacatgtcaatgtaagactaaatgactaatcagcgggactaatcaactcctctttttttttaaataattcaactggtagatcaacgcgggtttttaatctcttgtaagaactagtacgaatgtacgataataattccagtttctcacccgaaaaactgaagcataatgtttgctcacacactgacacacactgtggttaaataaaatatcgaaagttaaatttacaaattgttttatcgtaatacttgaaaaaccaaagattatattatgtaattataacaaaaagagatataataaattactggatttcaaatctctatatttttgtctccactttatcaaaaaaaaaaaacatcagtctccactctccacgcgccttttagtcgccctctctgaatacactacagtacaacgttgaaaagaattcaataaagaagatcaaaaagcaataaagttaatccttactttaattagaaacaattttctaatcataaacctttatcatatcgtcaaaacatatcatgaacgacttgtctctctctgttctctatatatatatgactcctcttcttcaaagttcagacacaaacataaactagcgtttaataaaaaacaagaaaaa

SEQ ID NO: 4869 - DNA, 918 bp, Arabidopsis thaliana
gtaatgggttcgagttttatcatcggagttgcttgtgtttttgtcatggttatggttcatgttttacttgagtgtgtgagtactctatctaaattataataatctccgattgagctatgaattatgatgtatcggatacatttgatcctaatgaagtatggaataaataataattattaacctttgtctaaattcaaaagaagtttaaccgacgagatgatttcgcttagagttcgatttcggtttaactaaaccaaatcaaccgataccgtgaatcaagacggaatcaaacccaaaaactgaaaaggttcacattatataaatgttatattttgatttagattattacatcatttctttcaaaatgattaacattttgtttgataactgaatatttcttctgttttacaatgtcattcatttcaaatgtttggcagacaatgaattggccaaaaaatagactcttcaaaacaaaaaaagttgtgtgttttacaaatacagtcgatacattaatctctcagttttaaacttttcaacatatgaatcttaaaatataaattgtagaacgtaatcatttggagatttgttatttcttggtcggctaattgactggagattagaaacactaagtgttggtcaaatatcttaaaacactaagacgaatgacgttggcaatgacgtgcataccttaaaatataaatcagtccttttctggtgtgatcttcaagatatccttggatacaaagacaaagagaaagcaaaatggtccttttatttatttgtttatttcaccacccataacttcatttgtgtatagaatatagtaaactcaagtaatcaagcaagtaaacgaaacataaaaaagaaaagtagtgcaagaaacagaggagttagataccaaaaagtgagagatatcga

SEQ ID NO: 4870 - DNA, 2000 bp, Arabidopsis thaliana
agttattcatgagttttcctacaaagcatcatgtttcaattgaaacaacactgtcgaatcgataccagtaaaatccctttacaaatcataggaaaaacaatataagaaagattacaagaaaggaaagaagtgacaactaacctacacaaggatgaaaaaagaggttcagctactcagaaggcaagatcttataacaaacatgacagaacaaagaagcaaaactgcagatacaaatccggactagatagaacggtaaactcatcggaaagcttgagacttaccaggctgtagcacttgttgataaatacattagtattcatgttggcaaaaagtaatcagagaagaaacgtcaccgtatttcttcgatgttcacaaatgtcaactctgtaagacaagccaaaaaatttaaccttcaaagacagaaacagaccaacaaataacaacaggctatcaaagctgtcgagacaagctctcttctgtttaggtgaatacatgaatcataacaacagaagcttagacgagacattttcactcttaacaaattatgtaatagcaatctttttcagcttttcagcgaaacccctaataaaattatgcaaataaaccatcaattgacaccaaaacatctcaagaacaacacaattcacaacaatttcgactaaatgtaacacaccaattcacagaatcatagattatatcaataaagacaaatttaaactaaccttatgaactcttgagattggacgcaaggcaagagcaatataagagaaactgtaaaaggggagagagaagcgagagaaaattgctacagcaacggaaaccctaaaccggcgacgacgaagaagaagaaatcgtttggaaaaagacgagccatttatatatattctctcgtcggcgaaaaaatctaagtcggcggtctactcttggacacaaagccaatcgtttaggcaaagaacaaagttacacattttttttttttacgtcaaagcccaattctaactggaccgtcacctatcaattctgacccggtcaaacacggccaatttcactatcaagtataaacaagtaaataaatgtgttgtaaactactctattatagttacatagacattttttcagttttaaactagttttgtcagatatcgctccaataatataaatttataaaattgttatcataaaaaataaattttcaattttgtcaagattgtggttttaatacttcagaccagaaaaaaatttaatttttgttttagtttgagtggttaggacatatgttacggaatttagaagaaaacttattttgttcggttacgttaaatttgaaaataaactcatctcttacgtatgcattcaattattatattatatacatcttttatctaaactttccttacgctgtacaaggaaattacaaacgttctctttgaatttgttaaagttgtgtttattctaaaaatttcagtgtatctccgattattccgtttttaattgttacatccactctgcctgccttattgaatgattaatctcttgaagaaatcagttatctaattaccttccatctaatccgattatttcgtacctaattttgtatatcttgattatttaagattttaaatataaaacaacttcttttttattcaaacatgtacattaagagtatgataaattatagcaacttatgtacaaaattttaactaaaaacataaaatgttgtcttaaaaatatatttttatgtttactaccattttcaaaacaatattagattaaaatgttttaaaaacattataataaccctaaatatttatttccgatttttaaattaatcgccaaattcatattgagccctcgagtaacgtctaaagatttttcgaacaagctcgagtggtagtccatttacaaactgtggaaaacataatttagaaaatatctcataacaaaacggcgacgtttcgaagttcagacttaaaaaggcttgggcccaaaggccccaaaca

SEQ ID NO: 4871 - DNA, 2000 bp, Arabidopsis thaliana
ctaattttataattgaaatttataataaaatgacaaatttgtatttaatttcacgggatggggttatatggtgggacgggtttgtgtggataataacacatttgattcttttataagaaaattaaatattataaatgtttatattttaaattttatactacaagtgaaattctagaattgactggtttgggttgataataatttgcgatagaactaggagtgaaatcctagaatgacaatcaaaatataattatataattaaatattaccacgggtaaaattctagaattgacggggttgagtcgatattaatatgggatggtgtactacggatgaaatctgaaaaacaacaatcaaaatacaattatacaatattaaatatttaaaaaaataaacaaatacaacttaaaactttaaaatttgagttataaaattttgtctcgcggtgtatcatacatttaaatcaaacaatagcataaatttaaagatcatcctaaaaaaaattcaattattttttatttaatgaaaatataggcctgcggtataccgcggattaatatctagttgtataaaaacaaactgaactatgtttccctaataaataaataaataaaaaaaaactgaaaaaaacaattcctgaacaattttacatccaattcatagtataacgacatatccaataacacaatttgaattctaatagtaatctctaatacacacttttttatttatcggaatatttttaaactaaattttaatagctacacgagataattgatctattgaagtattaactactaacatagattttaaggtctagttatttcacataaaaactaagttgtccaactactaacgcaattgacaaccacaaccaacaccaatattaagtatgattaccgaccaaatttgaattttataaacatatagaattttttttgccaactcataatcatatttttatatgtattttaatataaggtgaatgattatcttttgtttcatgtcatattgggcataacaaaactagtacaacaaagttgtgtgaaccactccttttatatagttttgttgttgtcttttcttccaaggaagattactagacttagacaagtggattatatatatatatatatatatatatatatatatatatatatatatattaactaatctttcaacacttgtggattgataattattcatacttttaataaaaattccatagttcaatgaatctgtaacaaaaccaagaagtgacgtgatatacttttggaactataatcatattgtgagctcaatggataagaattgattgtagtaaatgatgtcggcagttacaagtgtagttagatatatgcaataactcaaatcggacatgaactcattttaacttatctaaagagaccaccgacgaatcattttgggttcacaaaattgtacttcgatttctaagcctgaatgtgaacgcacgtttttgaatatttcaacacgtgtttcatatttcattacatgcattataacataaatattacatctttgagtctttaactagttgaccaacaaaaaaaaaaactttaactaagtctagctagttttgttactacatatataaaaacaaaaccgaaataaatatttaaaatttataatatatttgtgtggctaaatcaatcaacgtgtcatgaaggtctaattcaagttggtaaggaaatcttttgtttatgtccatttcccacgtgtcactatttgtatgacggctagagaaagacatgttgaattaactagtgactccggattatataagcaagcatctactaaaaagataggaacaacacaatttgattacactgagcaacacaaaactggcgaaccaacgtgactctaacgaagaaaccggcaatggccagtatcactacaatgccgaagaaataacaagaatcataaacgagccagaatattatcccccgggttacaacttgtctaccaccgcaatttcaaac

SEQ ID NO: 4872 - DNA, 2000 bp, Arabidopsis thaliana
taaaccatacatgcactagacagtttcatgggaagactaagattttgggactgcaaaattcttcttggaattgtgtagcggctttcaacgtatctttaggttatattcggtgaaccctttatttaccggcacagaatattacggttgatattcaattgatcaaacaatgtgaattagacgtctaattattgatggtcgccatatgaatatcttcttcttccttttccaaaccaacaccaacatcttttaatcgatagaagtgtcaattcgagctcgactctcacatctaatgcgtcattataagattgaaaatcagagacttgaagttttcgtttaggaacttaaaatgaagtttataactattgcttaacgtttttgttgttcatcccaagaaataattgacgttttcaagttaggtttttccaacccaatttattttattatccaataatattataaattctctagtgaaatttcattccttagcttccacgcaaagggtcgcttgagttttgagtaacacaagattggagagatcaatgagaatgttggcattggatccaatcctactatttgggaccagcttcactcgattcatcgcgtcctatttttgtccgtttacacatcttcggatcattcaattcttgtttaatcatcttcattagtaataacgttgccactttatttttaagacggatttatcttctgcaactcccaaattcatattcgctaaatcttctctaaactcagcataatagttaacttgaaaaagaaaaaaacgaaaacgataactaagatggtgaccactcgcatggtttagtgatgaatttagttaaaccgtatgttaatttccttggttaggctcttcaaacagaaattcgaaaacgatatcaaatgctccatgataagtttatgatttcttagcattgtctaatctaagagactagtaagaacatgaaaacaatattcgttaaaccaagtggtaaaacaactatatacagtatgtgtttttcgattataatgttgttaacttttaagattattatattttatattatttcttaaaatatgttgaggtttaaaagatttcttttcagaaaaggattaatgtcttcagcaatatatgctagtaatttactaagtgatattttgcaagtttgttggcaatatttaaccttttctgaataaaataaattcaatattaagaaacaaaattatatacatatagtagtatttaattgttatctatttttaaattatatgtgaataaaacaaagcaagtgtaactgtgtaattataacattggtacacgcacgggaaaaaacacagctagcaaattgaaacgttaatttggtaaagaagaaaaatattttatttttaaaaacacttaatatagttttaattggtgattttcccaattctgaacatatatatgatgataagttttccatcccaagttgttttttctcattagtcactggaaacattaattaccagcaatcagtagttactttggtattccccacacaaattcaaatttaaaagaaataattagtagtacttcttatgactgttttttttactgaataaaaaagaactatatataggttgttcttaactataaccactaaaaaaaggttctaaaattaattttaaaaagaaaaatatatgaagttaacttttatatattacacatcaaattccaatttcaggggctggtaatttggtaataattaaagaaactcaatggcaatgatttaagcacttctttatataagtccaccaaactacactgatctcctcaacaccacacacagcaaaacaaaaagctctctacactcaaaatataacgaaagaacaagaagacatcatcttagctcactatggctttgaagacggtaacaatatacaaactttctctattttttccacttttgatttaatgaatctaaaagaaaatattttggatgattggtatataggcgacgagtggtatgtgg

SEQ ID NO: 4873 - DNA, 996 bp, Arabidopsis thaliana
ggcagagcagagctctagtagggttaaaaggaaactagaaggttggtgattgatgtttggaagctaatcattcaatactcaatagtttgttaaggctaaaaactgaggcctgaccaatagttcgcgtggcccaatggataaggcgctcgcctccggagggggatattctcggttcgacctccatcgtgaacgaattaggtaataataaagacggcctgctttcttcagcccaactgatttatcggcccaatccagtgtctttattagtttgttttcgtgggatctctggtttacttacttgcagggattatctcccaattccaatccaaacatgccacacttttcttatctctttttcagatttcaatctcgtccaagaaatcgtttagtactcacattcaatttggaaatgtttttgcataaattggggttggatttcctacctctttttcactagattgtgcattatcaatttatgaactttttctggaaacatattaaattgtagatccaatattttatcttaacaaatctggatctgttgagaatgtttttctgtaatttagagaggattgtaattgtgtagtacatttgataataaacttaaatgtgaattttagactaccaccaagtaattatcatttcaaagaacaaaccaaatagataataaagaactgttagaaagtaaaattgtatataataagataagaaaagacattacaaagtacaaaccttctccaagtaaacttctaacaaaacaaaaaaatagatttggattgggaaataatatctaaaatcctatttaaaacaaaataaaaacaaaaaagatataacgttaaggaaaaggaaaatactagtagaaaaaaaaaacatgtaggcatcaaaaggaatattctcaagagttttggctataaaaaaaggtagagccgactcaagaggtcttcttaactcacacaagaaccaacacaaaacaaaaaatattaagaaagtgatatt

SEQ ID NO: 4874 - DNA, 2000 bp, Arabidopsis thaliana
gaaaactgccgacaaaacctgaggagatgagaacaagattgttgtatttgactagattatctcaaacaccgatgtcttttaagtaaatatttttttaagtctctaacaaacaaacgatcaacgcttgtccgtagtctccacggaacgtccactttaattaatgatatcaatataattagtacttccacattaacgattacttcgaagtaatttgtaagtataaaaaattgaatacgattctatttagaaagaaaataataatcaaatacacacatccaacatatgaattatcaaacctaatatgtttttaaatgtatcaatcgtaggttaaaagaaaaatatgtaatctatccacccatatgaaagttaggaaacaattggtgatgtaacaaaaaaagagattcactttttagggtaaggacatgacaagctgtactgtagatttcatgatggggtaacaccgatttccttgaaaacgagagatccaatcaataaaagtctctctatctttttttttgttctctcatggaagaaaataatattcaagacgcttaaatatataattgaaattcaacgttttcattttcgttaatggaatgagtaatcttttgaatgagtaacgtttgccttctttacacattcctctggtctcttaaccaacctaaacccacttcaccttaatttaacctcacaattaatcaatacgaacataaattaacattctttaactcgatctaacacaatgaagcaaattagcaaactattaaaccaataacgctaaaaattaacatctcatgtggtcagacatcgatggttcaatatagatttgtaacctcattcaccgaacaaacaacagaatcttaattgacgttgttcagttaatttatgaaaccaaacagtacattggtcgagtgactaataattcagatagatattttgttaatgtacaaacttgaattgaataatgaatgtagtagtattaacattgattaaaacagtatgtaagaaatgtgacttctaacttcaaaacaaaaaagtcgatccaaaactaacaatggcaaacattaaccacttttcaaactaaatgtacctttcaactatacttaccattaaatgtgtcttaacttttttttcttagtgacatacagccatgaaaaaaagttttaaaatgtatgaaccgaaatgatttaagctttgtaatttcatgatatttgacatgattgcctatatattttagatcacatgatggtaacgatcgatttcacattgcaataaaacaattatatatatatatatatttcattgtcgtattcattgtggttgtttaataattaaaccaaattaaaacgacgaaattagtccactttctaattatgttagcatataaacaaacaaagcagacaaatggccaccaccacgttcgtcctccaaagacaacgatggtacgtctcttttgaccctactcctcactcacccaattctctctttttttcccttacatttttctcctcatttgaaaaaaaaagctaaatcatcaaagtttaatttattctccatcaactatacgtacgaatatttggtgaaatcaccgacgaatacaatattcgaaaaagtaaaccaaatgattcataagttaaaaagcaataatcaagaatattcaacaaaaatattcattgagtataataacaaaacaattcaacttgataatttcatttctctctatttcttacaaccatattataaaactattatatctataaaatttgactaaaatgacgtcttcttcttgacctctctgtgttccccgagttttactcctcttaacactcctcgaaacaaaaagaagatgttcttcttcttcttcttctttcttctcctctcttcttagttcatctttcttctctttacttcacaatctcttacttttaaaattaatcttactcgccggaacttttctctctcacaaccgcttcaaacaaaatttctaagtttatccgaat

SEQ ID NO: 4875 - DNA, 2000 bp, Arabidopsis thaliana
atttcttgctaaaaagctcattttctgatttgtgacaaaatgagattttttttaattaaaatattatgactaatctctttatttcttataaaatattatatcttaaacattacaatttttctaacctcttatatcacaatttatttaagcagttccgtaaatttttcagtcatcatttttcgtggatttgtttttttttttttacgttccaatcaccaaccactaccgtcaagcacccaagaaagttgcattagttttacactgacaaatcgtcggtaagcacgtcacaattttttaagtcttaactaagctttttgccatatacatttccacaaaaactgctttttattgtcattttccaaaagcatatatttgtccatacatatatatctatatcaaatgcatgcgcaaatgtatcatctaattagtatactgagcttgaaagaggataaattttgtaaagagagtcgtgtagaatgtggaacatgaggaaaaaccaaagtggcaacccataaaatgttagaatattgctaagaaaacggaatcgacgaccagatttcagtgtatgaacaaaagaggaagaaaaggaaagtgaaagacaaaactaagattaaaatgaaggaaggaaaagaaatagtacgaaaatggatgtacttaaccccaaaaaaataagattatgtagctaaattttagtttaaccaattattacaatattcgtaaattttaatgtagcactaatcaaattttttttgtgacctcataatttttaacttttgcatctgattactatattaacacatgaacataattttattgacactagaagttttacatgttttcgtgggcgtcgttaccgatcatgttttcatgtagtcaaatggattcagaaaaacatgaggtataaaatagtaactccaaaattccgaggaaaataattttcaagtggccaaaacaaatattttctagtatttaaattacggaaaatgaaaaattaatgacatgagtttagagtaaacccagcacatctaaaatgacaaagaaagcgggtcaatcatctgaaaactgcaatttagaagcactattaactagtatgattgggagctttactgttatttttagctagagaatttaaaattaataattttgttccggaagatttaagatgtttatcgtacaagaaagtgtttaataatgtgtatcatgtattagacctaaataaagtatgaagagacagtgaaagaaaaacagagtatgatagcacaacacaaaagcaatacaaatataattaacaccatccttatcaacaaatacactgcgtcccttaaatattccactaaattacaaccaaatactttaaacatgcacgatagtgagctgtatcttggaaattcataaaaatgacataaacttttgactcatatatatacgttgaaaaagtatttgaaagtagactgaccaacaagtaaccatcaagaagcataaaatctaaaatatctattgtatttaaccatcccttatgcccatcattttcacaaacccacacatatacatacttatatactttataacattccaaatttcaaccgatctatcataattaggcatcaaattaaaaaatggaatatttgtggtgggagagagatccacatcttttgtagaaagtgcgtgtggggctaaacttagaaaaaaaagcaggaatagtgagagaggagacacacggcgttttcgtttctgcctagaatctacacttagtgttatacgtaaggccaaagagtcaacgactttggctccctctcttcacctcttctctattataaattgaagggccaataacccaactctatttgtcctcaaagatagtaaagaagccaaataataaccaatctttcttctatcttctctccctcaatatctttctctcactctctgatctccctggcacaactaaagtagagatatagagagagaggaactttggattgtttgtgtctttgtgacag

SEQ ID NO: 4876 - DNA, 1512 bp, Arabidopsis thaliana
aatggtacatcagtaactttatgccattagggtctggctggtatgttagatctctctaaaaaggcgtttgatctttgaaaataatttctatgtaataaatttattgtgttaccatcttttcttgcatgcaatttattaaaatgagtttgtaatatggtttcagtatcgaatataattggggtatcaatgtatcttttgagaaaaacatttaaaacgtagcagaactaattattgaaaactggtagcattactaaaaattgatctaaatcggttaatgatttggcacatacagtgatcaaatcagctaagcctcatatctcaccgtcccagagttcttcaagactcttataaggactcatctaatgaataatgacatgcctcgcaccaacctgccctgcaacattgaaaacacacgtctacaatttcgataacccaagtgttttgagcaaaacaaaggacgccctttgacccatttggactacaatgtgtggaaaattactgcatgttcaatatcagaaaacttggataacatgtcttcgatatgggcttttcttattttgtacccgtgtaatttcgctggcccaaaatccaaagcaacaagggtaaatttgtatgcagtacatgtggcatgttgggtcatatggaaacaggtcacaagactcagattctttacattgcggcgggtagtagtagctttctagtctaccttgagattgcccctgcccgtgattcttgagtcgggcacaggaagtggttttctgtcaactttacttgctcaagccatccccgcaaggtagaaacttctgtggtctttctcgttatttcttatgtaccatgtttttggtcgtttgtgtagtttcttctaaccttccacacacttgtcttgcgaattccttccacagcagagatgttaaatcaggaatattcaggatgtagaaacttctctgctctttctcaagtagaatgcacttgtggaatccctcagatcagatttcattggtaacgttcgttaacttcaacaacaacactttactaaacatgtgctaatcaattgtcatacgcttgtatttcttcgattcatttttatcttatgcaagtgttttctctattatgatttatttagttttgcataaataaggacactccttcggagtcagtataagaaaactataacctaaaatataaattaggcaaatgtccactcacccatccaaaattccattgtaaataaatgtttctttcaaataaatgaaaaaaaaaaaaaaaaacaagttggaagaaggaaccaaccaagtaattgccagtcaaaggaggcgactcacacttgaaaggataagctgacatggcagacaacgatcctgcgtagaaattgcgtgaacgtggaaaagtttgaggatatagccgtcatttcaaataattcgggtactattatataaggcttcaagtcctggttcgtagtacaaattgtctcacaaactcttctttcagtcatcacagaaaacaaaaaaaaca

SEQ ID NO: 4877 - DNA, 1181 bp, Arabidopsis thaliana
ttatactctacagaaacagaacaaacactcaatttgaaacctaaacatggtcgatgaagctaaagtaaacaacaaaaaaggaaatcgaaaatggcgtacagattggggaagatggaaaccctagaacttggaattggggatagtcgttttagttttagggctttagagaaatcgaatttttctacgaaacgctgcgactggtgtttatatgatatgattacacgtttttttgtatttgttctgtattagcttttgtaaaagttttcagacaaggattaatttggtaattaattagacaatttaagaaaactatatgaacaatttgactaagggtgactttttcaatctattgtataataattagatgagaatttaaacataaattcatttaatttttcaatgaattatctacgtaaataaatcatagaaaattaagatactctaataacaataccaacgacaatgtggattcaaagtgcctaaagaacaaattcttttacttatgtaaaaaatcctaaactttaaagaacaaaaattaaaatacaaagataagtaattaacattttattgggcttctaactggatttggttctatttatttgggcctacgtttgaaaacctcggtcttaaagaatttgtgtccagctccagcacaaggagaggcttatagaccatatgtcttttggtgtctgtttcaatgggcttacatgttttgttttcaggcggcctcgtcttcttgacacacacaagtttgtaacattgggcagtgtgaaacatacacaaaactaaacactaattaattctcaaccacaaatatttaagtgtgatggtgacttggtctcatataatatgtgattttgtaattttgttcgaaacccgcatatagagttgttaccaattaatacctaaatctttattccggatacgtgcttttaccaatcttaaacagaccaaaagaaaaactatgactaagttgaactgtatatacgtgttttaaactgtatatacatatcaaattgaatattaactatatgacaagattatcaaacgggaacaaaaaaaaaactatatgactaagttgtgatgttgtttgtcaaattttatgtacgtcaacaattcaacataattgacattatcgttgtttgtgtgtgtgacaacaattgattatagtatttttatac

SEQ ID NO: 4878 - DNA, 1664 bp, Arabidopsis thaliana
attattaccatggatcaccaaagccactatctaattcactgtagtgatgtacatgtagggtaacacctacacagtcataccatttgacggatgatgatgagttccctcctttgtagctctggcctgaattacaaatgcatgctctctagaccgttataggaacaggtatagttttctaacttggtttgtctcctaagttatttgtttttacctcctgcaagcgcaaaaaaaaaaaaaagaagaagaatggagctgatatgttttgggctgtggttctttcttgtatgttatctctggtgctatagaataatttatatgtatctttatcaaactctctggacaaaacctttgcagagctttgtattttctacttagacaggtttgctgagtgtattataggatgtttttttttttctctcagtctctattctatcttggtaattctccttcttgtttcttgattcttcttcctaatggatgataaaaaaaaaagtaacaaggttttggtcattataagttgattccatatcatgtcttcttttagtaaaatatgtcattagttgaaaagtgcatgaaatagtaaagagttttaaaaaaaaataaataacagcttttaatatggctaatgcgttcagtttttgtgattggtaactatcaaaatggtaaggtccaattgttgacatcaaatcgtaagatttttttagggtgagcagaagtataatatcgctattttttccgcttttgtgattggtaacaatcaaaatgataaatcattcattgtgaaaatcatcactgaattccttatgttttgttttggtctatgtatagatttagttgaacccaatgtgacaagtttattattctctcaatcagtgctggattctgcaaatcactttcaaaaacattgaattcgaatattgtaataagaaaaacaaaaattgtggggaggggaaatagtcaaataaaagggtaatggtgtcaaagtcacgcaatcatcggttacatacattactcttacatatcgacatacttaacgttaatcaaatctcgtttgacaaaccatcatcaataaagagcacaagaacaaagaagaaggaaaaagtagagcttttttgggaatcagaatcatcatcgatggtgaatccaaagcgtggcaataggtttttcaaatacagaattgtgtaaattgctctctatcttcttctctttcaaattctcttccttttgttgtattcaataactttttccccactttgatgggctgcaaccacatattcttcttctatctttaacttttcccaccaaacttctccttttttttctttttttttgggttctgggtctgcttttttgttgttgttgttgttgaatgaaggtccgtaagggaagaagacagatgattgcgaaagagcaagacgaatacaaattacgccaacaaggtcttgtttttcaaatggcttctcttttcctctctttcgattactccttactcttcttttggttgctcttccgcgttttcttatacgagaatcacgaacgaaaactccagattttctagcacacctcttctctctgcatcgccatcttgttttttcccccaaattttcgattttttttttgtataacttttgagattctgatagatccggtacggagtcatgtat

SEQ ID NO: 4879 - DNA, 2000 bp, Arabidopsis thaliana
tacaacaatctaagttatatacattaataaatacaaaccttcacctaagaaaatatctttaacccgacataaatttgttactacggacatgtttttgtttaattggagaaagatatatgattgtgtatggtgtctattgattgattgtcacagaagtataggcattttctgttattggcaaactaagaaagaaaagacattttccactagttatgtaatgcatcttcgaaatacccaacggaccaaacctgctcatcctttccgtttttgatattatataacaatattttatatcttttaatcgctaaaaacgaatattatataaatgtattggatgtccaaaaaaaaaaatgtgaatggaggctttcatatgctatatcactatcaaccaatcacagaacatctttgacagaaggttacctatgcacgtacactacacatacgatgctctttgtttatatctttgcttatagtttatcgatgctaaccactgtaagaattaagtaaagttaatgccaatttaacattaagttaaaattactgtaaaaagtaaattagataggctgccttttaaaaaaattgttgaattataaccatatttgcttttcaaacatgcatgtcccaagtaacagaacaaacaaaaaaaagaagaagtttggcgtaatgctcctataccatgggttagtgctctcaagcgggtcatgtgtacaccaacaatatcaatttttgggtgtttgcttttaactgaaaaagtaaacgcatcgaatctttattatgatttcgatgaataatgataaaatttgggacaatttcaattcaagtgaggaaaacgtgtctgtgccttcttggtaaatctaacactgaaatttgacacgcagttgcttctatagtcagtaattccaataaagcatctaaaattgcatttgaatatttaatcatagtcgtccctatcaataattgtcaccaacaaagataaagggtaaataagaaacatataatgaaaattgaatggtcgtagttttatatgttagttggaaccaaagattcttcaatctatcatccactcagagctacgtggacagtcgatattttgggttatataaaaaaaaacaaaattgtactataagacaaaagaaaacagtattaaaaaaaaaaaaatcaataacaagattatatcttatcccaatgaacaaaatgaaaatttagttattttgaataatgttacaggttttaattaaattatactatatcacaaacagcaagagtcagatacatcgaacggtccagctttcctcctttatttttttctggctatcgttttgatgcaaagttgtttcgttaatcgtgaaaattaaaaagctacagcaatcttctccgaaacttcatacactcgccgacaagagaaacttcatccactcggatttctcgtaacttgcagcactaaacatttcatgaaactattcacaaaagtccacgaaccttgcaattggccacaaaatttaaaatacttatatacgtaacgacaacctatccatatttttctttctaacgatccaaaactggccacgcttcgactccatggtgatattaactagggaagtggctaatggcaaacaagtgcttagaagtggtaaattcaaataataaccgtcgattatttctttctaaccgttattgaggttaccaattaaaaaaagtgatcacaaactaggtcaatgaaaagggagattttttgttttctttgggccaatgaaaatagaaactaagatggacaaaagaaaatattataattggacaaaacagagtcatttgagatttaaaacagagaagtaataaaggtcaaatgtttttgtggtgagctctcaaaaacagacataaaaaaaagaagcagaatcattcccatttataacaaacctaaacctctcttttcttcttctctttacctttttcattccaaaatctctctctctctctctctctttctctggctcgggaagaag

SEQ ID NO: 4880 - DNA, 710 bp, Arabidopsis thaliana
cttttgtgtgtgctttttttctcagacattaattatataagttttcgtaagcttacactagatgggttgtgtacttattatgttatggagtatgataatgtcataaacatgagaattttttcgctctttgttactcattcactcactctaaataggttgtgtaccctttttttttctggtttaagcaaaagagaaagacatgcatctagaagcccaaaaactctttgtgacaactgacaatgtagccttttaccttttgcatatcagtttcctaaaaagccttttcttaatatagaggtccattgcactccaaaggtgtgcgttcatgagcccatgtagttgataacttcatcgtatgtttatgtttactacatacgtcgtcgtcaagatggaattcacatctgattaaattcatttcctttgaaaaaaagattccttccaacatggctacaatccaacaccttcacttagaaaatttactactgaccaaaaccaagagcattttggtcgtattttaatatccttagtcgttgtctatgaataattaatatgacttacagctcgttggtcgtattttcatatctttattcgttgtctattaataattactatgacttattaacgtattccctgattagtacaactaatataaaatgttaatcttcttctcataatattcttgaagcaaattagcactgaccgatcgatcc

SEQ ID NO: 4881 - DNA, 2000 bp, Arabidopsis thaliana
tcatcattattggaatcttctctatagtttgttataacgttgttcacattattttttggttgtatacattgataatatttattgtatgtgtggcgctagtgtggatgctttaaattgatcaactactttggaaaaagtcgggaataggcacggctcgtgaacaagattgttgtattgaacaactctaagtacagcgaccgtttatgttcatgatttgacagtatatcaagccaatttggttaagtgatgatagtatttgatctactatacaaaacttcttttgatcttctatgtagaaggaaacgttgtataaagaagaaagtaaatgttaaatattttgagagaaaaaaacgtataaaagttccaatccatttaagaagaaaaagaacatttaaatgttgacaaatggttgaatttatttgtgatttcatctctgacatatgtatctgattcccaacgtatttgtaattaatgtgatcattagaaccacattaaaatacagtactacagtatgtatcatggtttagcgtttctgcaataaatacttccatactgttatctatacccaaaagaaaatattggagacaaatttgactttttctttttgtacatttgactttttaaaatagaacaggtagtataattagtgttgcgaggatgaatttgttttttaattaagggatgagtttataaaatacacctaaaaatcgaggttgttgtagttccaaaatacagtggactaaaaaggtgacttcacataggtagacatctctctgacgcataaactttaacgttttaatttggaaagtgttttgattctcgagcccaaactgatgctttaacacttggaacttgtaagtggtgaagagaatctttatctaataaactcaggatttactttgctataaacttataaccctatttttataaatttgttctaactaatgtagacaaatgttaaaatccaaagaaaaagaaactccatgatgtatttgttctttaaaaaaatataatttgaatctaaatagtaatgtattttgagaatttttacctaatttgaatcttttgaatatatatttttcttttgtgcaccaaacaatttggatattcaatttttgaaattttggctatccgtagatggacaaatacaaaccgatccaaacatagaactcactgcatatttcagatggaatttcaacatccaaatctaaaatttcagtacctaatacttagaaaatgtctaaacctaaatggctaaatttatgtacaaattagaaatcacgtgcccattgcccaccattgcttctttgcggcggcattgctaggctccacgtgtcagtcttgaatattaagcaaaactaaccaccacacagaactaaattgtcccccacatgttcttctatgtaatgtttgataaagcctagtttcagttatcctataaaatttactagtctcaaacaaaagtcaaaagctcaagataagaaaaagccagctctattacatgttactatgatgacattggcttaagaatagtaacttatacatacttaaacaactgaatgttttatgtggttattttcttaaatctcattatcaatatagtaaaacaattggtagtcctcaggtagcaagtgcaacaagctttttaacttctgtttagtttggtatttataattaagttttcatatgcttaacaatagcgtctgtagtccaacggttaggataattgccttccaagcaatagacccgggttcgactcccggcagacgcatttcctcattaaatcttttgcgtgaaacttcatcagagtaaaactatgtcgtttgaattagatcggtatcaccggaaccaccctaccggttaattaaaccggaaaacaaaccgctgagacttccccacgtgtgtggtctacaatctctatcgattccacagcacaaaaatcttttgcgcttttgagatttttccagaattcaatctttcgagtgttgttgaattcagaa

SEQ ID NO: 4882 - DNA, 667 bp, Arabidopsis thaliana
gatactagagagagagatatgaataaatacaagcagcatattttgttgggaaggattgtatgcatccagggattcgatttgaaccctatagcatcaaggaatcaaaccattgaagcagaaatgtctccgttggcgtatagcatccatgtgtctttgattgtaacattgtaagttgctcttttgcgcattacttctggatatacatgatgaatagtttcgtactctgtggttctttcagtatacaaaacttcttccttacttgatcattctccaatttgcctgatataaatcaatccacatgcattatgtgttaagcacaagattgatgaatcacctttccttgtggatgaatcgaggaattcggtttttcttttcagagaaataaggattgagaaactaaaaaaatcagaagaagaaaggaaaggagagaagagataaattcgtttagtttgtccaagttaaatacgaaggttaagtaagggcttcagatgccaacaaattggtaggcccaataacataataaacgaggcccaaaaacttcatttggatacttacttatcaaatgtcttcttcgccattctctgcttaaaccctaaaccagcctccttctctctctctgttagctgcgttcttcttcaagctagctctctgcttgtactctagaata

SEQ ID NO: 4883 - DNA, 2000 bp, Arabidopsis thaliana
aaatttgttggtgttatgatgcaatctttttgatgttttcctctgttcttttgcagctgtggttactggttgcttatatccttcaagtccagggtatgtttgtttcaagatttggtaaagagattgtttggttaaaacttgtctttctttatgtaacgtgacttagaagtttggtgttcttttacctgttttgtcttccacagaagtgcagggacaactcccacgacaggtactccttcaggaacacagacgtttccgggacctcctgcgtttggtccggccggagattttgatccttcaggcaataatggtgctccgagtttgttcatttcaatcgctctctcacttggtttctccgtcgtcattgcgtttctataaaaggctagtgagtgattaagaaagtgaggctgacgttttggatgtatggatgagattttgtcacgtgtgaatgcaagttctttgaggcagacatccatttagtggttggctttgttgtttaggctattttaattttatttcatgtatgtaagaaatgatctaatggaatctttctataagtgtttacatgcagagtaaatagaacatgtaaacataagtagaatgcaaacaatatataggaagtggtagagttatgtctaagagatgttgtggtgactggtgaggcaaaagttttatttcgatatgaacctgacttgatattttttttgtatctattccagctttgaatcattagagacaaacttattattcatgttgttctatatcttaagtttgaaaaaacatataaacctcaaatcaaatttaaatattagattagcggttttaaaacaagaccaaagatttcatacatatacgtgctaactattagggctattctctcatattggaagttaagtatgattttaatcttcattcattgccaattattttgagttggaagcccacaatctaatatgatatcaaagcccgaacatatcgagatcagtggttagaaaaaccatcatttcggagagacgttttaggataatgtcccacattagaagttgagtaaaatataaagtgatatatatataagatatgagtctctccacttattaacaattgattttgagttggaagcccacattctaatactaacgtacacctaaatactttctatatcaaaaaatcaaggttactaaaacttattaacacacaatttagtaatttactcataataagcccacatataaatcaaacctatagagtgaaaaaatttacgggtcggatttgcaatatttgcatcaagatttaagatcatcagcgttgttttcaccgtatgttagttatctcgaagatttagagaattatcactgtttttatcttcgatattcaaatcgttgttttcattgttattattccttaaataattgtttccaccaacaaaaatctatataaaaacaaaacatattataattatatactttttcatgataaactattgtataatataacttattttatgatttctatcaaaaaataaaccttttgtcccaccatgtacctttagttcaatcctaatttacatatatatatatatatatatgtatgtaataaattggtactaacttgtctaagatatatttttttcttttttttttcaagacttaactagtaatctctattgtatttttttcatatttataacaagctaatacaaattatttagtttgatactggaaaaatatagtatttgtttaatatttgaagatttgttttaaaaaaaaagttataatgaaatataaattttggaagattactcccacatctaaaaaaatacgatccattgattctcctctattcaacggttcgatatcaattacacacacgaagttaaactcttccctcccacaccttataaaaccctatacatgaaaaaaaccttcatcttgaaaaaacccctttccaagttttgcaatttccactgaacagaaaactttcccggttaagcaaaattcgcc

SEQ ID NO: 4884 - DNA, 2000 bp, Arabidopsis thaliana
ctatacctagagaccattcaccttgaaggtaattttactgattcgtcgatctataactagtctaagaggcataaagctgaattttacaataaataacgaagacgcccaaatctaagaagcgcaagttttggaaaaatttgagggagtaaagagtacaaaacctcaagtatgagagggccgaagaaatctccggacgtcgatgatcggagaagatgctattgactaagaaatacagtgaaagggacgaccatacaccaaaatcgcctgaggaaaatcgaatgagagtagctcagaggagtctttcccactatttttcttcaactgttttgcctttttttgttttttgggctttcgtatttattttggtgtctaatttttaactaatactagtatatgaaacgaattatatttttaccaacacagattcgattctatatcgaaattggttatttatttcaggcctaatatgtaggtacaatcatatggacaacaaaatgatgaaatatttgtaagttgtaactaattttaggctctctaaaattagatgtaaaacaaacaaaaaatgcaagtaacaacattataagtaagaaaggtcaaatttatattgttggatctttcttcatattcttatcggtcgctaattaaacatgtaaaaagccgctgaaaaatcgaatttgtatgttcaaaacattaattcaaaaaggctgcaactcttttcatttgttagagaacctagtacctaccattcatacctagtacaattcgtgcaagttttaatatctataaacctctcttttactttcacaagtacactaatactaatattttagagtgtccatccccgagaacatcacaattaaatgaaaatttattagacgtacgatgaactgactaagattagtttaggggaactatatattttaaattaaattaaaagcattactaaacatgaaattatgagtttggtcgatataccgttagtacatagtacataacacatagtacattccattcatttgtacttttagtacacatggctctttgatagacacaaattttagcttttgtggaattacgtgagtcttgtttgctgtgatgatgtcaagagaaagtgatactaaaatatagtcatggggtttttacagttggacgagatttttacacattttgctttgtcattttacaaaacgaagtaaatatgtatttccaactataccattatcatatcatcaccaagaaaatccaatgttctgagattcctcttcatatccaccaaaacaatcatattcaagaaaaactattatcaatccgaatattatgagtcttcaagaccatatatgtgcgtttttgtggaagaccgtgcatcgtttgagatgccacactctatgagcctgcttcgaataatcgaatccttaaactctcactaaaaacacggatcatgtattcatatccaatcaaaatctatccaccaaagaacacaatgttcatgaacggtctaggaaaaacagtccgtaaaaccaagctctctataagtttataggttactactactagtagaaaattagaaatctaaaatggttgttttggaaatactgaccccaaagaggttcgtgctttgactttcaaacacgtccgctagattttcagtagttgacatgacacgtctgtttttttgtccgacgagtctcaattctcgagccttctcaagctcttaaaatctcaaataacgacccaattatagacggccacgtagatatcacacgtctcaatacccaatcatagatggtctgtgacgatgtacgttgtgagaatagcaagactgaatctctttttaggtggtgaaacacagatgtaaaaaagagagatatattgaaatcaaggagacaaaaacttaagaaaaaaaaccaaaaaaaaaagagagaggtgaaattgattttctgctcgcgatcgtcatttcaatttctaattagctttcctggtgtttcttctccggcgtaatc

SEQ ID NO: 4885 - DNA, 2000 bp, Arabidopsis thaliana
tcaaagactttgacataagcgaaaccattggttacttctctaaattaaaatgaaatggtagtcttctaataaatatatatgtttaacaaacaaattggcataatttgatcgttctaaccaaagataggatttcgaatccaaattggatgggatgactagactattagatatttagatcgatcaccaatcaaacaaaataggcgtgcttttatattcattaagctggtttaaaacaacaaacaatccagcatttttaattttagtggttgaatagttaagttaataaaatcaaagataaacagaaaacaaacagctagtttttcaaattttggcgtttaattttatttggaatatttttttttaataaaacacacaaaaaaaaactcttttgacaaaaattggcatcaatactgcatatcgcatagccccatacatacatgatacatgccacatctcttaaaagatgagaacaagaagggatgtatttgaactattctgacaatattatatatacacacacattttgaatatgaatctctcttcttcaaagttctgacttgttccaaaattcttatccacacaatggaggaaaaaaagaaaaagaaaagccacaataatgagccataaccacaaccacacccactcaccagagactttgtgtatccgtggctctcatcatgacatctcatcttcctttgattcttcacaccaccgtcgatcgccacgtaggatttccccaaatcaaagcattccacataagcacaatcttttatgtggccagagtttaatcaacatttgtttttcttacaatgggttcgtgagagccacaaataaatcaactatacgattaaataaccatatctaacaaaaaaaaaaaacattaaacaattatagtccaagtaaacaaatactcgcctactatgtaccatattagaaagttttttattctcccccaataccgatatattattttgtaatttaaaaattcattgttatcttatcctcgcaagaaacacagatgttttggatcagtttgggaagcgaagaagtatgggagagaagtaaaaaacaaaacaagtggtttataaaaaaagagggaaagataattgaacaaagatacgtggggcccattaaacttgtgttatggtccagacaaatcccaggtgggctcacgtggctacgaagcccattgagaacctgattcgtccacgtaggacgggacagaatctcgctctcctccttccccggctgagatctcgccacgtcatcgactaaataaatctctcccaaaaaaatatctcgaaactgaaccatgagtttgtcgccacgtacaaacggggtttggctttggcccatacgcattaataactggttttcaaaaatcatttaaacttatttatcctaataacgcataattaatgtgttttacttaaactgtaatgattctaagtagaaaatgtgaaacagtattttttatccacaagaaaaaataaaacacaaggataaagctaaaaacaataaagaaaacattactgactcaagtaatttaaataattgcagcagatatagatctgataattatccaaacaaaaatctcaaataaaggttaaagtgataaacccatctctaaagcaaaaagatttttaagttgaaccaatccttaattgattaaatactatacgttattacaaagttaaattgaaatgaaatggatactaaccacagaataaaaaaaaaaggaaggtgctatataaaatagagtcattgtgaaaccaaagaagagaaatagattttttagcagaaggcagaaaaagacgaaactagcctccaaagaattgttgaatcacagaaaactcgccacgaaaaatatcccaaatcctgcaacttgcactttcctattcttcttcttctttccttatctctccaaggaaccaaagcatagacacaaaacgaacaaccacagaaacttgaaagagagaaagagtttgattttgattaaa

SEQ ID NO: 4886 - DNA, 2000 bp, Arabidopsis thaliana
ctgcgtagtgtgtgcgcgtgtgggtgaatgtattcatacatctatatcttacactacttgaggacttgcacacatgcatgtggatgtgtgacttactccatcctcgtttaggcatatatacacaataataaatcatgcacaagcattttagatctgtgcttctagagttttggatctggctcccattaaccaaagcaatttatcaactcgaattcttttgtcgtttttcttgatactaacatataaatacattttatttataaactacagttcagacatatggatcgaagatccacagtactactccagtactccatacaagctaatacacagtattagaagtaatcaattcttatggtccttggtaggtatagtattattaaataagtgatgcgattagatcaatgcatgacttttagctggtcgtctatttatggatgctacctaaacataaatttaatcacatgtcatttattatttattattactcctaaattgttctgtccattaaatattttataagttgttacttgctactcctatcaaccattaatggtaatctttgacgcagattctatgagctatactattgcattgttttccatcatatattatcaatcacaagtaactcttcacaaaaaatggcggtcaataaagtgacacttacaaaactcaatggtttaaataaaaactacaacattgctgaaaaatatacataaattttaaacacgaaattggttaacaaaacaaaattggcggtcatctcatgtttttttttatatcatagtaaatctcgaaatgtgctttgattaaagatcagaccatcgaatggtgcactagcattctcatataatttgacatataaaatagtataagtaacaatatactaatatagtagtagtatattaatcatttgcataaatataaaacaagaattggtccaatgacccatcgatggcatcaatgccttgttcttggatgaaacgtggcatatacagtacggtgtcggattaagacatgataccataattagatatcgtatttttcgaaaacgtcaatatgttgttagttgattttatgagaggcaggtttttccaataagataatctttcttttatttaatcagaatccaactcattgactttgcaattgctgataatttattcacgatagaagagtattgatctgaagcaattacatagtgataaatctagtagtcattctaaattattaagatataaaatcaccaaactggaaattgcttcttctttttcttgttaacatcaaattggaaatagctataagagaagagtatagctaggaggacccatcacccatccatgatcaggctttaaatataatttcgatcccttcatgctgatggaccacactcttcccatggttttggataatattctagttatagtccatatcacattttacaccaaaaaacaattcttaagatttcaaaaaccattttacatttgagcccatgattattatatgtaaacaaaggttcagaatcatgcaagttaagatcaagtaatatcaccaagctctacgtttattcaacacaacattggaccttaagaaatctttatgatcttgtaaggtgaattatggattcatactaattaactaaaagagagtttgtatacgcgctaagttatcaaatttagagaacacaaacaacaaatgaacaaacacatttgtttggaaatctctaggcccaaaccaaacccattgaaagcccataagctcaacatcactgatctatttcttagtattgggctaatatagtcatatgtcaccaaagtccaaacaaagaaaaatcttcaagccgacaacccgatttccataaccggatagaccggattgtgggtaaggagtttatgcgggttgacccgatttcacaagcgtatctgtcttgtttaatttcgttactcgtcgtcgtcccttaactcgagaaaaattagggttacggattccgattagcaagc

SEQ ID NO: 4887 - DNA, 1816 bp, Arabidopsis thaliana
aaaaataggtttgttacatgcagaggtttttgtgtgatgatgaaacaaacttaagggagttgatcaaattctttttctttttttggggttagttatatgtttttgtgcattgcttaaaaagctttagagagatttgtagtttgtaaatgcttttggaatgatgaagttgattgaatattaatctaatccaatcttttggatgtttgagtattttaaagtggtctttttcttgaatcttgagctttgtttgccaatgtggggtgctgagagtgacaaacagtagttaaatacccaaacacaacgaaacaaaaaataaggtccaaacaaacaaagaataggggtattttcgtcattagcttcataaagaagggttaaattgttaattttgagggtttcgcgtaggcttgggcattcggttaactcgggttaatcggttcggtttaatcggtttttcggttttttcggttctttaaaattctgccgaattgaaccgaataaagattcggttcgggtcggttcggttcccaatttgttcggttcggttataggctttaaaatcaactccgaattaaaccgatttttttttaaattcggttaattcaaaccgagtaatcccaaaaacaagatattgggtcaaaaaaattgtagaatgggccaagataaacaaaaaattacagttacaaattaataaaggggccaaaacgaaaataaacttcagcccaaaataaataaatttaagcccattaacaattagggttcatggtatcttgccgccgctaccctcttctctccctccagcggatctgcgaaggagacggtgacgacaatggcgagggatgagaatatctccgtaacaaaatctgcccctaacgtgctaccatagtcaacaccacatgcaatggagagaattgacttaaaatagccatggatgaggatgattaggctactacgttttaattctctctagaataacactggcatggatcgatgtcgaggcggagtaagaagaagagaacaaaagaaaagggatggagaaggaagagttatgaaaataacgaaggtgcaagaagaaggttgaaggagaaaagaagaaacgagatagagaacaagaagctatgaagattagatctaggttttttttatctttttataggtagtatctattaaccgagaaaaccgatcggttatgtctgccgaaccgaaccgaaccgagaaccgaactccaattataattttgccgatcggtttagccttctcttcatagtcggtaatcggaaccgaaaaaatcggtttgttcggttcggtttgttcggtttaatccgaaatcccaggcctagtttcgcggatccatcgaacttcttctctcttcttcttctgactccttagccgacgacacagagaagaagaagacgaagacgttggagagtcacatcaaagcttaaacctttcgtgatttattctcctttttcccgggttcggattaatttttcaaattccgacgaaattcgctatcttctggtgcttgagctgcttagctaagtgaagcagagagagtacaattgtttatcttttgtgagttatttaacctttgtttatgatggtttctggttttgatttcaatagtaggcgtcgttacttggtttagaagcaaattgttagggtggtttcttaaagggggctttatacataatctactgtttactttcgtgctccttgcattttgatggtttgttttgttctttagtaggttaaattaaggagattcttggcaaaattctgaagtagcagcagtagctgtgttttgtgttcatagaga

SEQ ID NO: 4888 - DNA, 2000 bp, Arabidopsis thaliana
tatgaatttttaagaaaaaacattattatgaaattcttttacatgaacagaatctttaaaaaaaaaattatatgtgattttaataaaaaccatgtattactaaaaaataagaatatatttttaaagaaatcacgtgtgatcttaataaaaaatgtgtattactacaaaatatcatgataaaaagagatattaaactgaatagaatgttttttccaaaaaataccatgtgctttttataaatattatgtaataagagaaaataacaaaataaaaagaggatattatgttatcgtatgtatttcggaaaaataacatgttacaaaggacatttacgtaattacacgtgttctccaacatgttttcgacaagatactgtgactcaaggttagtttgtacattcttttcaaatctatagtcatttattataaatactctagattatttctgtttaataaaataaattagtgatagaggatatatgttatatacgttttataaactattcagcttttttttttgcgtcaacaagtatattagattgactcaagcaaatcaatgttgagtaagattgtttacataagtgataatatgtggttcggtacgaactttcgtgctatgtaatctatcttgacattctgtttcaaaaaatcaaagaaaaaaaatcaaactattctttgtcactaaatcgcccccaaatatgtaaaacaaatttcccattcttgtcagaaagatatcatctacactgtaaagaaagtttttctcgtttgtcttggttgataatacatttcatcgtccaaacacttttatctctgcatgtagtgtggttaactttttttgaaggtttacaactccaatatcatgtgttccattattcagataagtacaaaaccatcctagcctttaataatatgtttaatggaagattcaatgttatttttgtttgaattttagtctttttagagagccgtggaaaaatccaatattgaatttatggtccattaaattaaattatttatacatgatttttagtgaatttatctatattaaagcatttaaatatatgagtggtgggtatttcaaattatcaattatggttgaaacattgaaatgatatttattgtgtaggtcagtaagatattttaatataactattattatggtggagaacatcacaatacaagttctatttggaaattaaatttgagtgcttagattatttttttcagtttacaataacatttttttttttttttcagaaatagtgtcaagtatgtttagattattatatgatagcctaaatattggaaacttttgaaaaatgtctaaatttttaatattgaaaattcaaatttgcagtgtcatataataattttttcttctttcacatgtagttaagaatattattaaaattttcaattgatgcttcctttttaatttgttttaccataatccatatagttgtgtttgttgatgcaatatatgtataatttttcgttttttcgatgttagattaagggtttgaaaatactgatacaactatataataaaagtattattagtataataattataatattattaaataattttaggattaaaatttatttattaaaataaataaccttaatatatcttaacatttatttttaagctattaacattataaaatagtaattatgttgtaaatactctctattaataaagcaaatataaatcttacaaataattaaattacaaattttagaagattttaaaaaatattaactatgaaaagaatatatatatatatataaaactaaaataacgaatataaccatgcaaaattgattgtatatatacaattatgtatgaatataattcacgcaacacgtgtcagattttttctagtatattataatgatgtctctgttttctgttctttgaagtcgtgcattctcatctcacacgttccaaggtcaagaaaggatcgttgacaagaactaaagatctccaagaagata

SEQ ID NO: 4889 - DNA, 1955 bp, Arabidopsis thaliana
tagctttctgactccatttttttcaggataaaatctgtttctttgtgacaaatttaaggctctctgcaagtcattgatagaatacagatataaatgtacatataaactgggaattattggctcatatagatgaaaattatctctatcttgcctataaatatactacaagtctacaagtgtataatgtattttacagactaataaaaaaacaaagcttttgaattccattttcattgtctgctctaacttcatctctaagttttgtaaatgcttaaacactgtgatatctaattctaagtacactacagtagttgatttaaagatcataagacacgataaattgtctccaccaaatattcaataatcaaatagaaaaaatcaataagaaactttacaaaatcaatagaaaaacactgagctgaagtaccttgaagcagataagaccaaaagctcaactccagaatcatcgctgatgtccagcagagtcagagaaacgataatgctccgagaccacattgctctcttttttactatcagaaatctattgggcctttggacctcctacaataaagcccatataaaagggaaagctaccgttttacggttgactttggactacaacgacgatacggtttattgcatgaagatggtcataaatgagttctgaaaatagcatctccaagcttattccggaaattctaaataaagaaacttattgttcttatctacgatactagtactaacaatctcgttgatgggcaataaagtattcttggtcactttcagaaatatcattagtggacatttattagcagtgttcttggtctctttgtgcattttcatagtcagcaacttttgtcgttaatgatatcttcatttcaaaaattagctactaaacgactcaaacaaatgtgatattataaatttactatacgactcaaaacgagttgtgatattattttaatcgtttgaccacccacacaagctaagtaatgcttcaagttgattgatcacgatgtggtttctttaatcccaacttgactttgtggaaagattaaagagattgaagatcctctcctccacttgaagagctgcatccatgtgtagaagacaaatttctctgttgctttcttttttttccttcactttcttcactttcttttcttttctaaatcttttttgtttgtgttttcctcttttgtgtctttttatttatttatttctcccacctgtttttcattgacatatataatataattcaaataaaatgacacattaaaaaattaaatgacaatcacttagccaattttactttgcaaatgcaagtagtatttaaagttgaaaacctttgaaaagagaaactaaaagtgtaaagacaatatgaataaaaagctcaaggaatgagaaagaaaaaaaaaatgtaatgaatgatttatgtaaaagtaagctatttttgaaatagaataaaaagctcaaggaatgtgatgttagaaaactgtacgattatcaaaagaaaaatgtgggctcagggaagaagatgattatgagccgatgagacaatagagtcacggggttaaaatacagatttaaaccttggttcaatgaggtcaataatgtaagagttttgtagcctgtcagaaatagatgtaactatttcaaatggatgatcttctctacacaagtcacaaatactaaacaaaaccacaactacaaggactatttaactgataattacgttaagaccaaaacatatgtactgtttaatttctgactttgttagaaaacaatcaatatagaaagacaaattgataaataaaaccatatgaaaaaaaaacaaagacccatacaacaaatctaacgcaagggtcattaatgattaaccaagacaaaaaatatctctaatataaatattatccactacttcattcttcactctacgacacacaaaaacaaca

SEQ ID NO: 4890 - DNA, 1410 bp, Arabidopsis thaliana
ggttaagactttcgggaaggcttcaagaaaccgatgcgttgatgtggatttagtttccgaggaacggaagcgtaagagactgcaaagaagccgagtagtaggatgatgagtacaaaggagaggtttggttttgtctcaagtcccatctctagagttgattttttaagtgtttggcagatagtttaattttatggtttgcatatgatccgtctcgttccatttttatagatcatctatatgatgttttactttttaatgatattgttaagtatatcaacgtgccaaatttggtgatttaaattattgacgaggttgtaatgagtagtaggtggcactcgccactcggtttctaaaggtaaagtggtttggtcaagctccctggaaatttcgtttactattatataattatacactttttgaaagtaaaatctaggatatattataatgtttcttattgataattgatgattgtgaaagggcatttggtcattggtaggtagtttttatgtgaggtttaaagattttagcagtatgtaaacttttataagtagtttaaatgttaaatttccgcaatatggagtatggtgcatgttaagcaattcattgtcatgattgtgtagataattattattttcgttgtcgtaaacgtaaaattcgccttgttcactctcccaaatttcactctcaccattctaagattttaaataaaacttttgtaatgaaatgccggagacatggcaaggttcaaaagtagtttaatggttcgggtgtttgggtctccgcacttgagacaccatctagctgccaagtggggtatgcaatggctgaataacgacgatacacacacacaaggaaagttttgaggttctcttatcatttaaaattgtctaaaagtttgtgatgtttttgatatcttttgaatttaatgtgatttttaaaattaaaacgttttgatatatatatatatatatatatatatatatatatatatactgtttttcaaagacaaaaaactgtatttaaaattaccgagaaaaacaaaaaaaaaaatgattcaaatcaattaattaactcgttatgattaaaaataaacgtccatactccttagtccatttagattgaatctgaatagtgtaacggttaagacttgaatagtaataaaatgtcaagattcggccgtgcggcactgtacaatgtccaatctaatcctgccccgatggcaatctaaagtcttcttccaacggtaacttttcggacatgaagtagattcacaatccaataattacatgacacgtgttctaaatccgcccccaacggtcgtctttcttcatcatcatcctttgacccaaaatataaaaagaaacacgaaactcagaaaaaagcaaaaaaacaaaaagatctgaaacaaaa

SEQ ID NO: 4891 - DNA, 2000 bp, Arabidopsis thaliana
gtttggtcaccgaaagatatgttatggtctcacgactctcacattagtcatctgtccactaaataaatactaaatacaggttttaaaaacttgcaatattgaaatggtgaaaagtgggagaaaggatgaggtggcgtggaggcataatttgataaggacacaaaactgcaatagaaagatcgaatgatcgatcatgcatagctttctattgacataaataggaagttgggtacgctttttgacgaataagctccaataataataaccgttaacacatgcactaatcaatccattattacacattcccttattatacagtttttgtaaagtcaagattgattcgtggacgaatggtatctcttgtggctactccaccaaccaaaatgagttgttatttttaacctaaccaagatcacgattattcggttccaatacgaaaaataagtaaaccccacgcgttttgcaatttccattttctaatgacaaagagcttaaggttccccaatttgctacgtgtcttagctacacttaaaagcttaagtccactgaattttttaaaaattaagagagcattcttgaaaacgcttatgcattaagttgttttcaaagttgggaccgaagtctcgatcaatcgttcgaagaaaagctacatggattctgaagacggttaatagctttgttatgaaaggcacaactatgcatatctatttcgggtcatacacatttccgtcccaattttttccgttccatgaccatacccgttatattattatttgtttggaaaaattaattattttaacagatacataaaggggtaggatataagacgacgagggtctaaaatctaaattattagtttgattttttctttaaaaaagttacttcaaaatattaacaaatgctcaaaaaaaattacaaatttaaaaccatccgaatcacgtgaaatacatgatcttgtatatttgaatagtgaaaaaattgagataataattttagatagctgaattaagctaatggacaagatatggttgcaccggtccaagtgtagtagatagacgtcccaaagaaggaaactgcaagtaaaatttgcttctaagtcatttaccacgtggcttgttttgattggatacaaacaacaagtcagcctacgtttcttgaactactgtatgtcatgttctgtctctatagagtcttctggatccagaaagctacgtttctctttctctctttgtattatccgattaaattttagagtagttctttgagtcagctgcttctatgccattttctagaggtttggatccaatttcatcatcttgttgatccgtttatcttcaatttccatagattttttctaattgaattgacttctttcgagaaaagtttttcgagcagtttcatttgttcatcagatttaatgcttaattatgggtttctgaggcagatctggtcactctcgattgattgcttctagtttgcatccattgaaatgatcaggcattagcttgtttgttgtatcttctatcttgtgttattgttgactgttgaaatcgttagttgatttatgtttgaccactttctttggacttggtgtctttttatgttccttgaataaagtggaatgttttgcaactacaattgttagcttctacaagtttgaatgctattgttttgactgttgctttaagattgatgttatgcacaaggcttatctgtttctcctttgcaactactataagctaatcaagtaatcgtcaatgcagaaaatgggagagtctacggggtgtgggaaaggaggactaatgattccaaatcataagtctgctaattcttataacctctcccttgagttgtctcttgttgactctgtttgggattgtaatgttcggaccatgaggtattcctatatacctgagtggttgtagtctttgaaatcctcttagacaacgagtttagtgcattttactttagttggaatcaaagagttatagcaagcaata

SEQ ID NO: 4892 - DNA, 2000 bp, Arabidopsis thaliana
tttaaatcttctaaattcttgcttttagagttattatatcattacctaaaaggcaaaaaatataaattttttaattattattatttatatatttaaaattcataaaacattattaatatttaaatttataaaaagtttaatatatcaaaaaaaaataacatcattatataatatatagagtttaaaacatctcaaaaaaaaattcgtcatattttgtgattcgaaattttaagaatgaacatatattaactaattggcgaaaaatgtgtgggtttaacgtcccgcaacgaataaaatattttgacaatgattcataaacatattataaataagatcaacattaataaaataaataaattttttttgtggatggatttggcgggacgggtttggcaggacgttacttagtaacaattgtaaactataaaataatttacaaattatatatatattaatttaaaaaaatgaattgtctacgcggtgtaccgcgggttaaaatctagtagtatatacattcgtaacaattattagcattcagtttgatttttgctaataatatatatagtatggaatttcatactgaaactcattctaaaatttgaaatatgtagaaattaaaacagttaagtagacacctgtttccagttttgctaatatatattgcaaattcagaatatattttcaccggctaaccatatataacaagaaaacttgataattagtcttctaaatatgtatgaatcaaaaaatttagtaatatattatgtatatatgcatattttgaagaaacaatatacgactagtactcataaaacatagagaatgttcttgaagattggcatttgccaaaataaaattcaagtgcaatgaagaaaaaaaaagctaaagtaatgttgtcattagcatttttatttttatttttttccggagcatttttattaatttattaagggcatattttgcacatcagatcaaaggagtactttattacagaaattgaaaattcgtttgaagacatgttgagaaaatcaaggatcacggccttctgaaattctgaaccttgggtttcccatttcataatcacgagcttgattattactagtattggaaagtaaaataagatgattaaacaagtgattttctcaattacgtgtcactaacactaagggtaattatgatgaccaatgggtgacatctcgattttatcaaacgtcccttaacttttttcgacgtcgagattttataaaccagtaaaggcattctctttcacttttttcattccctcatttttatagaatcagtttaagtttttcaattgctaagggaatcgatcgcctatcaggagattcttcacatcccttataagctcatctgaggcaagaaaacaaaataaaatgattcaaaaactacatcaaaaaaaagtaatggacatgaaatgattcaaaaaaagtttttgttgctatttttgctctgcacgaatgtcacgtttgagaatcttatcccttcataaattccccaagtgtcaaatgtcatgcttcttgttgctcataaagacccttttagattccctgagatggatcccccaaaaatatatttcttattaggttgagattctctaacttgtcctttcaaatgtctatgggcctgaaagcccataaaagtcaaaatttccaaagttggcccaaaacagaaagatacttctgcgtagacattctacaaagtcaacgcttaaatatgtcatattcttttactaattcaaatcccaagttactagagaagcaactcgtcggccatcaccaagaacgtggctccaagttatatatgattcggccgaattttgaaaacttcttcaaaaacatatagaattgttctatcattttattgataacttccatttcaccattcctataaataccattcaatagttttcttcattctcacacaacttagacaatatctcaccattcctgtaaacacaaaaacttgtaatttccaacgaa

SEQ ID NO: 4893 - DNA, 1362 bp, Arabidopsis thaliana
agccgcgttccaagaggaggtcaagtggattcacttttctataatcaatattaaattgtagtcacaaaattgcctaaacttatatagaccttattttatttttgaacatcaatagttgtcgttgaaaagtatcttggggatatttagatttagcatatgagtcaatgttgggtccttaagagttgaggctacaaatttataactcagaaaaagtgtatatgccctttaatttttggcctattggtcttttatggcgtcaactccaatttcagtttgaaaagaaatgtcaataactaacaatgttgtcttttgactttgaaatcttagaagtttcgacttacccatttctacaagtgttaaatagcactgttattcaaaatcttatatttgttaattgtgcttaatatattttaaaatttaaatacttcattaaaatccaatgttattcaaaactaaattacttttgaaatatgtgtatatgaagtcatttgaaatgaaatctcataaagtttcataagtaaattattagaataaaaacccaaggtaattgtatagattttgaaatccacacaataatatcgaattgtaaaatctagagaattcaatttcaattcatgaaggagtgttaatcaatcatggattttaaagttagttgattgaatataaaagtaggaaagatgtgggattcatgtggtggtttggcccatctccatgatctctagtgaatttcagcttgcagcaactttcgttaagatcttacttcattgtgtgttggtgttgagcctcactggattggtgtgtcggctttttagttcactcagagttaagagtcttcgagtaagactctatcactatttaaataattaatgtaattgagttatgataattcaaatggatctccttcattccatagttgcatttgacatttttatataaaacttgctgattatctaagtcacaatttgagtccttggtaatattcagtttcaatcatcaggagatgtctaatagattaaaaattaaagatagaaatgtctaatggattgaaatatataaagtgactcagccaaaaacatgttaactgaaaatcttgtataaaatggagattctctgataacatgttcaaataactctctaataaataattagaagctttctttggttgtggatcccactctaccatctttatctgccggccattatcttccctctcgtgcttgctaagggccacctcaacattaggtagaagcaacacatcagtaatcatcacatgtgacaaaagtcaacattaaggtagctaattctcttctttgaatgtagattgaggaagagaaaatcaaaagctatctcttgttgttagag

SEQ ID NO: 4894 - DNA, 1730 bp, Arabidopsis thaliana
tcggtgatgggttttaaagtttttacaccatgcaaacgttgtcgttttatgtaatttaagcttgctttgagtgagtctctaatggctttgagctttatccaactctataaaagtcctccttttgatagtatgcatgatcttttgtgtttactcatttgttatatatctaaatagctcattttgcattttgttttatatataacttgtggaaatatgaaataaccaaaatacaaatgaattctaaaagacatcaaaacagtataattgagcattacaaaaatgtaaaatcgagataaattagttattagggttactatcctgctattgagatgcccaaattaatcaataaaatgaaaacaaaacaactatcttactatatgtatggttaaatctctactcccctaacattgtgtattactaggaagcatgctttgatgaattgaaatatgaagtgagtgcgacacaacacacaatatcaactcgtagacactgactaatgaagagatgtgatgcaaagagatcattatgtttatctcttcgtaaaaaaaaaacaaaaaaatggctaaagttattcgtttatgatttcaaaagagttttagtgatttaaattgtcatgtaaaatctgttgttactcaatcaagacttttttaaagtatgttaaagttttgtgttattcaattaaaacaaaagaatatttgattgttaatgatttaaattattgtgttattggttcatgactttctacatttttctttacaaaatgaagtcatggaaagtcatgtaaagtattatcaaaataaaaagattgtttgagaaactttacaagattatgaaaaactaatcaacaagattataaaaaactctctaacaattatttaaaatctttcatttctttactttcaaggatttaattgaaatcatcaaaattctttgtaaattaggaaccaataacacccccttaaactacactacaaaattttatttgcttctaatgattctacacattaagaacatttcaatttatataaaacattttcataacaaccaatccttgtggtagttgagttcgcataactctgctttataatttgtagaagaaaagaaattgttttgtttttgtgtgtttccccttcatccttataataaaaacatagaaacgatttacaaagtcaagtgttgtttttatacacttctctgttgtttcacccaatgtgttttaaatccactcgaatggcctacaaaagtcgctaggtcttgtagtttagccaatagaacaaatgacacatgttgtagtgatctgtttaacgaagtcacatatgcattgatatcgatgtacactaattttattttatttttaagttgtctgcatgtacagtaataataatgcatgttgtatttaaacttaactattttccctgtctcttactaatatttgaataaagtagtcaataatgatcaatacatacaaaacaaacctttcgatcaacaactgcgttgcacaatctctgtttcatttttatttatttttgtctgcatgtacgactataataatacaagttgtgtttaaatttaactaattcgctgcctcttactaatagttgtataaattatccaacaatcatcaacacatacaaaacaaaactttctcaacaactcttgcacaatctctgtttcatttttatttttgtcttctcctattgactttttgagtttctcagaaaatccctagt

SEQ ID NO: 4895 - DNA, 524 bp, Arabidopsis thaliana
gcaaagatccaagaaaaccaaaagcttttgtaatttgaaccagtttaatctaaaataaaaatgagttatatatattgtaggcactacaaataaaattggtaagtgtctcaaggtctcacagtcttcatgtatctttgttgacttctgaatccaagtcaagtgtacttatggccttcccgtcttgttgtatcgttgttgacttccaaatccacaaaatagattactaacataacaaaaacaagtaataatttttttttttcaagtggacggacacttgagccaataagattagaataagatacaacaatatcaagcgtctatatatctgttttcaccaaactcagcctactttaacaacgttgtgtataagaagttttcttaaaaccgccaattaaaaggtttcaataattcaaagtcaacggtaaacatctttacagaaatatgatgcacttgttcccaccaaccttcatatatataaaagctttaccaaaactctgtttgtgggaagtcctcttagagtggtc

SEQ ID NO: 4896 - DNA, 1045 bp, Arabidopsis thaliana
aggtttcactctcctgtctacaagttgctttcatgctttaatgtactggagtttttaggtgtcacttggaatcaaaactctagtttgagatatttttgttgttgtcgaagtatcaaacttttattagtgtctctctcactcaataacagagtctcctgcagtaatggcctaatgggaccctttgattcgattcggttctctcggcctatatataaaccactcagactctgacacttgtcataaaacccaatcctcaagttggtggaattgagttttgtgccgtttatgtcacaaacaaactcacgatactctttaaatgagaaaaaaggagagaatctgatatcataattgaagcttatctagtcagtgtgtgaaatatcacgagtgaatatgaagtgacaaactgtaaatctaattttacagtttaacttttaaattttgtcaactatcttaaaatttataactgttgtacacgattttaaaatatcattacgtgcacgagaacaaatatgacttctttaaattccaacaaatttaaatactgacgcaaccaagggaaaaaagatacataaactttttaatttatcgactatttccacaatctataatttaagaatcgttacgtgatttttcgttgtcgacgtcacatgatttatatttagataattcattatgtgtacacataagcatgactacttcttcaaacaaacacaaaggcaaatacaatgtacggacgcaactaacaaaaaataaaataaagatgtgaggttataatttggtcttgagtcttctttaattttattaaatttaaaattaatactacatagtatcattataattatgagttcttcaatgaaataagattactaaggggaaattaaattaaattattaaaaaaaagagtatttaatttggtgaaaaataaaaaataaaaacgtgaaaaagagggactcatgggataaataaaaaggaaggaagagatctccgtcacacacacataaacactccacacgctctgcttcgtccaatcaccaaacacgcttta

SEQ ID NO: 4897 - DNA, 2000 bp, Arabidopsis thaliana
ttgatttagagctggtacgtcgacatacaaatatatgattttgaaaagtaactttttaaaattatgtttttaccaaataaagatagtttcatagttaattttgaaactggaaaaagtaatctgataaccctaataaagatattaaatgttacaagtcactataacactatcgtttaattagttcattttctttccaatcacctcaaaactctaaaaaatgtattttgaactaaactttagaaagttaaaagacagtatactgatgttttttttttttctcttttggtgagaagtatatactgatgttttaagtaacctcgattgtgttttctttggtagatgtttatttactcctcgcaactgatcttcaaggatgtatataaataagaaaaagcaaaaacagagaattatggatgcttaaaattttttgacgaagaacaaagtagagttaaataaagaattaaaaaaaaaaaaagagaattataatccttgattagagaaaagattgatccaacatgcaaaacaccatacacgtaaaaatctggtggagagggtccacacgtttgacaactcaagttctaaagagacgtacgtgtgctatttcattacttgtaaactttagaaacattgacgatcaaagtaaagaatcctaacaatcatacatactacatgatacaagaaaacaaatattgcataacttgtctctttctgtcttcgatctaatatgcaaattgcaacttgataaacttataaaactagaatatgatttgtgcgtgtgaatcgtgaaatttgcttttgtttgaagccgccagtggtcatggagtgtttgaattgaagaccagttggggaagagtttaaaagttgaccattctcactcccaatatttaaccatcgttgttcatattttaataatgtttcgtcacacgtccacatgtgaaccaaaagggaacgttactttccatgtcggtaaatctcctgatattttttagaaaataaaatatctaaatgtcacgtaggaattgaaatcatattatataacccacttgtatattaatgactgcaataactgaaatgacgaaaaatcaacttcccgtatcagttttttatttctccaaaagagaggtcaaaaattgtaacgtaaattgacgtaaggaaaacaatcattacaagtgacgtttcgttgtaggtgaaatttaatagtatataaactatttgacattagaatattcaaggtatggaaggtagagaagtagaacagcttggatttacattatttgtatccataaatctaactaaacctactacttattcctcctctttgattaacatacatgtaatttaaagaaaccagccaaattcgttatatatagttgagctgtaaagggcataaagtaaaatcaaaatcatacatatttaactacacttttaggcaattgataaagcacattattttatatctataataagtttataaccaaaaataatagtaaaactcgatgtcgatagtttaacgacttacgggtgtactaagtaaacatccaaaaaaaaaaaaagtttttatttcattaaatgatcgattgaaaaaaaaaaaataaatagattctagattaaaaacttttttgttagaaaaaaaattcctaatgaattaccaattactattgggttatcttcttattggattctctttatttatttttcttgtaccaaaaaagaaatatgtcaaacttgataccaaaaaaggaagaaaaaaacaaataaaatatgtaatgtatgtaatataggaatataagtttaggcataggtatatgcattaatgagagacacctggttagagctatttgacgaacgcggaaagcaagaaacgaagaaagaacagttgaaactttccaaattccaccgtctcttatatattcttaataccaaaaactaaaactcaaaaggaaaaaagaaaaagaagaagaggagctaaaaaaacgacgtcgtagaaggagattcttgcc

SEQ ID NO: 4898 - DNA, 2000 bp, Arabidopsis thaliana
aagagacaattcgaggccaggtcctagattgtaatcatcaccttatatcacttatacatatgattaacgaacaagcatgagattagtctttattcatttcattagaacatgtagctgggaactacatgaacaaaaaatccccacatttcataacaaaaaagaaaagccaagtcctagggaatagggatcatataggtaaaacgataaaaggttatactatgatacacttttttcatttatacgttaattaatgactggattagtgttttctctataatcttctcagctatagtatttaactaattaaacaaggaatagtttctacagtgattttctttaaataaagacttatgttgaaagaaatcaaaatagtaaaccatagttgaaacaaaacatccattttaataacacatttcgtctttttaatgtccaaagcagccatcagccatgtggattaattggtgctttatgataagactccaaatcgttgcgtaggacgttggtcttattattactccacttgatttttgattaagccgactttaacgggcttttccacaaggcatcacctacttgtgccttggcccattatcaaaaaacctagtagaatattctcacgtcatctttcccacgtatatgtgcacgacgtttttgttattttgtacgtaaacaagaggactggcgtttttatattccgataattaaaatactgaatataattatttaaacgatttgcatttgtctgtgtagagatgttgttgcaacgaaaggaacgattagagagaataaaacgaaagtcgcaattaagaaaacgtgtctttgacagtcacagtgggtcgacttaacctttcgacgtcagacttaacaatattttattacattcagcacgtgaaaattgcgttgtttccgattagttttatttttttaatgggagttgcttattaatgttttaaatttggagggatttatactttattcctgaaaaaacataaacgaagaatgaatctaatcttttgtttattggtgagtaactaactacctatattcaatttcataccggaaaattttgtattatgtactaatatactttgttagactcgtcgttaacgactaaacgaatcttgtaattttccatagctttcttgacttccactgttgtattgcgcgtttcaagtgttttcaataacttatatttgctcttctctctctctctctctctctcttttttgttgttgttgttgttcactttgatgaatcttgacaaagtttacaaagttgactctatttaagcaaccaatggcaaaagatgatcgagtgaaaacctattatgtgtatatagcactaaacattatttgattaacatccaaagatatatatgagtttatacagtttcttagtttttaaatcggtggattcttttttaacaaaaaaggtttaagatcttgtagattgatttttgttcgtcaaaaaactttattatagatggatttttggtgagtacagataggccacaaaaagtgaatttaactaatttcttaatcagttatttaaaatcgtcaagtatatatggattatcattttataatgatttgggttacaaaatatcaaagaacagccaacaacaaaaaaagaaatcgaagaacaagatcatctatagaaaaaaagacaaatattactgaaaaagaaagaccaaagaccaaaagtccaaacaaaaataaataactaatatttttgtcgctgttctattttaagaacgaggcaaaaaaagaacagaaaaaaagaagaaaacgaatcttctaagaacgtaacaactatcatcaaatcaaaacctcaaagaaccttccatggactttctctcattccatacctttataaactcatacacaactacttatctcttcacttcattagtctccaagaagaaaacatctctcactctctaaaatacacactctcatcaaaaaccttctcttcggttcagaagcattcaagaatccatt

SEQ ID NO: 4899 - DNA, 1077 bp, Arabidopsis thaliana
ggaatatgaatatgtcccacgtaagtgagaggttctccttctgaacaattcctttctcattcataaattgttgttcatccatcacttgcagtctcttggattttagggttttagctaacacagcttaacgggtgccttggcctacagggtattggcgttttggtacgtagaagaaaccttttggtaaggtcattgaagataaacatttgggtaagcccaaagaaacagagttccgtgcattgcaaatatgcaatgcactgcaattattagttgtttggatttgatatagagactgagtctcgaaaccatagtatgtaaaaatataatcacgttcaaaagctgttaatttgttataatcttataacaattgtgttttaagatacaaacctactttgtgttatgatatttgttcactattggttttggtatatatccaaatcatttttcagggaattaaatactgactttattctctaaaagaaagaaggaaggccacaagatgtcaagattagtccacacaaatgccaacaaacttgtattgatgttaaagaaaattaatgtctcctccaatgtgtaatacagaccgcaaaaacatttcagccgacgaaattgttgtgcaacattgtccacaagattttacggctacactgtatacagactcacgaaaaagaaaacattaatagtcttttcagtttccataagatcgctttacaataatatcaaaataaaagtgaaaaagacagagaagaagagaaacaacgagagccgcagaagttgaagaaatgaggacctacaaggcattgatgtaagaagcaaggatgtggttccttttgattcccaaaatcctcttaaaatctcataaagcccttcttatcttcttctcttctcctcaacttgaatacacagaaacaaaactgcttttgtctctcaagtcatttgtcttataaaaaggttctgttcttgaacaagggaaagaaacaaaaggctgataactcctgttttgtagattcctctgatattcagattcttacttctcaggaaaaccctaaagaaaatttctgtttttttttgagaaat

SEQ ID NO: 4900 - DNA, 1335 bp, Arabidopsis thaliana
atcgctgttataattaagcttctaaatacattcttttatcccaaaaaacagaaacgtaaaaatcagatttttcttgtatctcaagtaaacagaggttttcttattgtccaagaaactaggtaatgattccttgagtgaaacttgagttacagacataaatgttttaagattaagctaagaaaggacaaaagtaaattttctttaatcatatatattacggatatctagtggtgccaatgatacatgaaaactaaccttccgtcattcgaagtattcgtctgcaagtaattcaaaagccatgttgagatgaaaacagagcacctttcattgagcagagcaacaccaggaagcctaaataggtcaataacctctttcaaatgcacactagtttatatcagtacaaagattctataaaatttgatgcaactaatgaaatatcaagctcattttgtgtttttcggtgacaggcaacacatatggctcttttgggctttaactcttgacttgagtgacatacgttaccagatccatattgggcctgaagcaatttaggccttataagcctcgaattggtttaaaatcgagtgcagtagccggtaaatcttttgtaacggtgaacagtatgctcgacaagataaaaacgtaatctcttttcgttttgttaaaaggctttaaaaacgtaatatcttccgctctaacgttacagttttaaatcaatagaaccagttgacgcaatcaaatcattttatgttttacaaacattacatgactcactcatacggttttttttttcagttttaaattttaaccaaaggaacatttattagtttgaattttacatttcacaatcccatctattaaaaaaaaaaggaaaaaaaaaactgatcattttgtttgtcggaaaaaaactctaataaattatatagccagctaagcaaactcttttaataatgaaaagtttaaaaatgtccatctttccagcaaaacaaaaccaaagacaatgtcgtctttgctgcgaatacaataatgtttgctaatttgaacagacaatgttgttgttttgttcttaaattatattaagaaggaatttctgaaacattagtattattttaattagtggattagggttcactccacctatacagatagagtcgtgtcgtgcttctctggcatttccaccaaaccatattttgtacggaaacatttctttcttctttcttcttcttctcacgatcggtcaataacttgctcataacaatttcgaaatcctctgcttcatcatttgaacttcgatttaagggttcttgaattttcgaataaaaatctcacctttaa

SEQ ID NO: 4901 - DNA, 880 bp, Arabidopsis thaliana
gaggcttaaaagtctaggtgctgatattgccgaaaatgagacttaggacatcaacggtgacttcgttcgtgggtctttgatttaggccattttgtttagattttgaataaggcttggttttatattctactttttggagactagtgtgtttaagttttaaggcttaatgttggttgaaaataaaaaagaagcttaaagtttagaattgacatttaaaagatttattaatttatccaatttagttaaaaccatgatttacaaaattgtttattacaattccttacctttataacaacaatacatccataatcaattaaaaaaaaaacaaattaggaaaatgaagcttcatcaaatagtgattttctactttttctatggggtcggagatagattgtgaaataaaaacacatatgttttataaaaaaaccatgaacttatgactctattgttaaccaccataaataaatatgtttggtttattaaacaatgtatatctcttaggaatggatacttctagattttgatatttctaatttcttacaaaatttgtgagatgagatgataactacatcaaacttttttcaggtctaaaaaatgaaataaagcatgaaatatgttaccaaaaaaggaattttattttttgtgataaaagcattttggacaacgaaaatcaaattgaaaagaaaatgaaacaaaaggcattgggagaagtcgaggaggcgcatgttaacacaccatgcgcacgttaaatcctgtctttgccctctctctgtagcgaaacaaaaaaaagaaaattgatcaacctagataaaatagcagaagagaagaagctgtgagaggaaaaaaaaaaaaattgaagacaaaaaccgccattgaaatg

SEQ ID NO: 4902 - DNA, 2000 bp, Arabidopsis thaliana
tacgtggtccaaattgagaaagaaatagtagtaatttgattacgtgaattaacttcaaaggcacacaggttttatacagtttatgttcaaacataggttacatcaagattccacgccataccaataactcacttgaaagaaataattaagaaaatacaaatatctatgtttgttctagagtttaaagcaagacaaataattgcaaacgtatctttgtcacataatgcaaaacgtttgtgaatttatatattctggcataacgaataacttaattaatttcatctcttataaaatatttcttgtatacaacaaaaagatctttataataaaaatatttgaccgaccttactaaaagtgaaataaacaaaccgccataatttgtaatcgaaccaaaaatcgtttttcgaaatctctgaaaatcgcgtatgactaaatgacaaactcataacgtgttattgattggtctatcattttaaaatgatggtaaattttggtaaataaacccaacatggatggttcttctaaaccacgtctctgtctctaatttatctcaaagtctctaaaagaaaaagagagtctataaatacgaaaaaccctccgcaattttcttctcccctttcttctcttcctcctacattctcgactctctctttttattagggttttcaattttaatcaaaaaaaaaccctcaaatctcatttttggatttggtttcttctgcgatctctgagattcaatttcttctatcaaaggaaacaaaaaacttcatctttccgaagattttttttccttccttctggagctcttttgaatcaggtttgaattaatgaatttcaacgtttttgcttaaactttataaataattcatttctgagaatttttggatctagttcagttttttcttcttctaatttaacattgaatattttctcgttctctgtatttttagttccgttttgtttcctcgtacgttacaatattatattctgctgcaaaaacaaacattttcacagttttgaaaattatcgtcatttggaaattaaaacgcacgcaattttgtccttacacctaaaattccagtttttttttgtttcattctaataaaaatataactgtatagacgagtttttgtttaacttaattcgtaagttttttcacatattagtgttacaaaaattgaagactgatttggcatgtttatttaagttttgtactttattgttaagatatacgtgtgatttgtcaaattttctagtgatgttttagaagtttgtcggtgctctttttaaatatttgacctaccatataaaattttggttaaaagatgttgaaatttccggtacttgtcacgatcacttgtctttctttttttcctttatcaacacatagggtaaaactgaaagtaacatattgaaggttacgacaaatttaaacaggagaatttgtcaacatataaaacttactttcgcttagaaaaatgaaatttcatttgtgtcgactcgttaaagaacagaaaacattatttatttttccactacttttgtgtttaaaaagcatgaaagttttggaaatcttatagaagttaatttatttattaatttccaaataaagcatttaattttttttaaatttacattataagtgactttgttgatttgttgtgtgcaggtgaatttctaattgaatctgaaagtttacgatgaacaatttgatatgatgataaggtacttagtcaagaaacaaaatattcctaaaagtaaaatataatcttatatttttttcttaactgaattgtgttttttttttttactggtaatcagttttgtttgatggagctttcaccaacaagcagtgacaagaaaacaatgaagagatggtttttcatagataaacgagttggatagagtgttattgaagataaagaaagcaaaaaacagaagttcttgcattgaagcattggttttagagtttattgaagcattgtttagagttttgatta

SEQ ID NO: 4903 - DNA, 2000 bp, Arabidopsis thaliana
tctaaggaaagagatccactattactactactatacatatataactataaaaataaataaactttcattgagatttgagccaaacagagaagaagaagaagaagaagaagagaagatctccagcggatcagtccccgctttaaaagcattggcggcgtctgatttcatttctctctctctctctatctctctttaattccctcaaagacaaagcctttttctctatatatatatatatatctctctatctttcgccattttggtttttgcttctctctgtgtgtgagtgattatgatgatgggattatctttctaaagctttttgttttcctgaaaaattaaaaaagaaaacttttatggttcttcttctcttctgtgttggagttgagagaccaataaatgctgttagtaatggttagttgagatgagaggtaaaaagatcccgtagtccgaggagtgtttggtttcttgcaaaaggatagtgaggcaaaacatgggtttggtttctcttgtctcctttcattcatcccttttccattaatggtctctccctcttccaacaccaacctcttcttttattaactaacaaacattttctgcctttttctcctcttctcacttctctggttcttctgtgatttgatcggttcttctaaaaagagagagagtagaagcttcttaaagctgcttcagggtcaaacaaaagtgtcttccttttggtaaacaagacgaagaaatatgaagttcatgaagctagggtctaagcccgatacatttgaatctgatggcaaattcgtcaagtaagcataattttattttgtttttatcttattttttaatttgatgggtcaaatgaatcttctactatttctgttctctgtgtttttgttctgttctctcttctcttttctattcatttatctccacatgtattgcctctgtttagttcttgtatgatttctagaaacatatgtcccatcttctcttggttcctatcttttttaacacaagctattaaaaacagatttcagtgacttccctgctaaattttcatttgctctatatgaacagagatagctaaacttggtcaagatttgcttaaacactgttacttgccagttaaaatactctggttttgatcttagagatagaaaaccaggataagtttgtcatcatcatcaccattattgtgattggtttctctcatcatattttttttgcgggaaatactagaaaagttacaagaaatggggtatatgagtttcaggagtggtccatccattagatgatctgtctttgtttatgtgttgttgttttgtggtcctgatttgtaagagcaaagagtggaaagcaaaagggaatgatgatgatgatgagttttcttctaatttagaaagtgaagaatctctctttacttttgttgcttatgctttgtttctctaaatatctaagacatctcttccaagttttgacctctggatattctaaactaggctaagaatctttgtttcctttgtcttgttttgtaagtgaattttaggcaacaattggacttttcttaggttgtgagttaaacttgataaacatgcatgtgcttatatggttttgaatgtaaacataacatctgaaatgtttaagaaaagagaaatgtctaattaatatgtaagagttctcgttgagctgattatgttcttagtttcaatgtttaatctggccattgatttctaccttgcaggtacgccgtttcagatcttgacagcgatgttactattcatgttggcgaggtcacatttcacctccataaggtacatttttgtaatgctgataatagaagtagtttctactgagggattcttaagtggtacaactttttattagagatgtctcttttatgctcaatgttacattttcagttcccgctgctatcgaagagcaatcggatgcagcgactggtttttgaggcgagtgaggaaaaaaccgatgagatcactatactagac

SEQ ID NO: 4904 - DNA, 2000 bp, Arabidopsis thaliana
tgaggtttatgtcaagttgctcaatgttcatacaactttctatataatatagagaaaactagagtttactatcttgactcggtctggcgaagaaggttcctccaaactattgacattaaaataacacacatgatgatccaagtggaagaattatgtctactagaaattatataagtatatacattagggtaatcaacttggtctcccttatgcaaaactcggaactaattttcaaaccaacaagtcttgtatgcattttgaattgtcaatatatatgtatgatacatatatcagctaaaaggatctatctgtatgagctaaaagtggataattaatttcgatcgataggaccaaatagcattttttttttgctcatttcaatagtttttttttacattctttccattttaaacttttttcaaatgttgtgtgtgtatatatgtatatggtgctgatccaatcttttaaaatgtatttgaaatatataagaattctaggaaatgtaatatgtttatttatatttacagatcaaataaagcaatcatacggctacttcctggacgggaccaaattggccaacggacttgatgacttggttaaactttgagtaacaaaggataaaactgtcttttaagacctggtttcagattcaaaggaccatatattattaatatatatccaaccaaataaatccaaggtaggccaggacattgcatgggatgagctagttttataaacgtgctactggtagatgcagattttaatctaaagttttatagcataacttttaattattactcccataaatacattattactcagattttaatgtactgattattttaaaaccgttgttaatttacttaaccttgtaattaaaccactatcgtccaaacttatgtgaaaaacacgcgctaatctgaccactagaaacattacacgtcatttctttttattttattttggacaaagacacgtcatatcataaggtttcaataataatgcatatatttttccgccaatgtatatttttttatcaatctctgcctcaaaaatttgcttcctctgtttcgaacccaattgggcatcttcgtcgtcttcttcttcaacattcatcatcgtcatcaatttctctgtagctctttcacaagtatttcttcaatttcatagcgagagagaaataaaagggagaacacagagatcagagagaaattcaaaaacgaatccgtgtgaggacgttttaaaactgccaaagagacgttttacttttacatgcacatagagacatacgtttattttgtgtagctatagctcttaagagtttgaattttctcgagatctttgaccggagcgaaaacgacgaagatatagaaaatctagcgaaacgacgattcggacttgggagactctcttgcgttgtgcttggatctggttccgttgtaaatttgaggttctaaattctttcacattgtttctcgttgattcattttgatttcgattctctcgtattgcttcgtttgggcgatgcgattagttaggaagagatcggaatgtgtttccggtattgtaactttgaatcgaaattgatatataacagtgtcgatttcgttttcctctgatgtttttttctgggaaatctgatgattttccgagaaaatggtttagattccttcaaagcatttctctcgtgaagcattcgttgaaatcgttgactctaattattgcgtggaaacagtgtaacgtttctttcattggcttaaggagctggtttgacttttcctctgtttcgtggatagctagaatttagttgttggactaatcttgaaggaacttatctagaattgaatctttctttgttggtgtattcaatattcattcttgtttctatttttgtaacttctccaggttttgattgaccagaggaagttagctttgttcatctagattaggctattattgaggtgttgttgtggctctgaagcaataaaggatttgatgag

SEQ ID NO: 4905 - DNA, 2000 bp, Arabidopsis thaliana
atgggaaaaatctttatgttctttcgattattctcaaacgacgttgttttggacagattaacagtcattaacggggttttaggttctattgataaagacatgtctattttggcctggtcaacgaatttttcatgttttaaatggtagttaacgtttagttcatgttttaaatggccacataagaagttgatgtttaaaatggccacaatttgaaacttgactaataaagttaacggatgataacggacgttagaagttccgttaatgactgataacgacatgtctattttggcctggtcaacgaaagatcatgttttaaaaattagtcaacgtttatttcatgttttaaacgaccacgtacgaagttgatgtataaaataaccattttttgaaagttaggagattaaatgacatttttcccgtaaatttttggacatattatatcaacaaaataatttcctcaaaagtatggagagttgacatgttcggacatcgtgggattggggaaaccggaaaacaaagtcaaagcaaccagagcattgcattaagatctctctgtctttttgtgtctttgcgtatttaatttttgtttttccaaattcattcaataaatatacatctaaatttacttaactagattaacaaacagatataaaaatattactacctttattcttaatatcttatccatttttttcttaagtgtaattataagtcttccaattgtgatttcaattcatgatctcctctttctacaaagtcttaaaagaaaaaaaaattgctatgaattgatatacacaacaacatgtccaaacttagctaaccatttgctaacaagaacattgttttataatgattttaaatgccactattttgcattacttgagagagttggggaatcaaacaaatgttgaataaagaaacaaattaataatgtaacccaaatacaatcgttaatgagcgaagctgctgaaagagaagacgccgaaaacgaagttgaccagaacctaccaaacgatcaaatcgatcggacaaagaggaagaagaagaagacaaaacccgaacaaaagagaaaaggcaccaaagaataaaacttttttgttaatggagatttgaggaagacgaagaagagattgaaacattgagaataatggtggagggttggcgaaatgggtttcgcgatgctacgaattcgaaacctctcttcgtgacgatctacgcgactgtgatcattggcgttctcgtctcttccttctatgtattctccgccatttactctcccaccaatggctcctcctcctttctctcttttcctcctctttccagtaacctctctctctatctcactcacactctttgcttatatctgcttcacattgctttagagattagatttgcgttctgagtttgatttcgtaaacgaattaatgtctaatcattaggtgagattttgggaggttaggctctttaattcattggttctgattctaatccgagctcaccgttgaccttaaatctcagtattcgttagaaaaatcacttctttattgtttaaaactttggatttgctataatctgagatgggttttgactttcgatcactttagttgatctgaagctcagcttttgaatctgatcaagtgataaactaatgtatttggatctgcttgaggtgtctgaaagttttgatttttcataagtctagtgttactctcccacactacaaaacagttcagtcaattggattttacgtttcatggtatttattagttgagcttgcttgagtatacattaatcttataaacagtggaagcttaaatgttgtttcttttctaattgtagcttctggccgaattcatagtctcccacaagaaaatgcaaccttagagttaccagttgctccaccaccaccaccacaagcactgccaccgccagttctggaggaggctcaaggcaattccttgggtaaaatttgggtgtctcctcctagagataagaag

SEQ ID NO: 4906 - DNA, 2000 bp, Arabidopsis thaliana
atgaatatatccctttataaaattagttaccatatgttctctttgttacatgttgttgaatcatagcaaattacaaatggatgataaacttatggttaatgagatactatagagtaatcaaaaccgtaagataacttaactatcagtataaatgatacattgaaaaatgataactacttgattaccatgatcggatgaaaacttggttaattaataacataacttgtactaattatcacagaactaactgaatcttgggttttaggatgatatgggaggtggagggaatgaagaagatttggtgggaagctgccccattagagcaaaaaacgtgcccaccaactcaaaggcctcattagcccccaatgtgcatttttgttatctttaccagttgcgttttttcttctgttttaaaaaaaaaaatatatctcatagtttgttttaattcaaggtgcatttatttcctggctattaaatctgcaattcttgtacaatagttcttgtctttttcatgaaaataggttttgttttatttgcacaagataaaatatcttcgaagctagtaaaatagtaaaagaaggaaagagtccattaagtttataggtgcatgtgggtttcacagagagttcagaaaatacaaatagaaagctatactttttacaatggagattattcttttgtgtaacgtttttatgtaagataatgtcattttataagttactaattcactcttttttattatttttgttggtgttgtttttctacttctatagatacaaaaacataatatttgagttgttttacactgtcttgtaagttctaattgattaatgttatgaacttagtttatgcaacgttctacaaacaaagagctaattttacaccagcaaaaatccctcaagtcctacaattatatgtccatcacaaccgagttcgaacaatcatataataattatttttgttaatgaaacgaggaacgtatgatatgagaaaaggtcatttcttaatttaaataaatgaaacagtgatatatctttggacgttatctctcgacttgtaaacgagtttaattacattatgcgactcaactttgtaatcaattatttaaagttctcaatttttgtcaattccgttacgtaaattattattagattaacaatttcaataagataacttctcttgaatattttccgaatatttcgttttaattagatattacaactatggttataaaaataaaataaaataaccgtaaaagagtcgtcgaatttggaatataatttgtaatagtactgtattctcctgtcagttttagacacgtggcagttcacgtgtcatatagtcataacccgtacgtttactctttgcctctttcccttttatattcaaaactcctttttgattttgtctatcttatctcgtgaatcgttaattcgttatcaaaagagcttaaaaagctttaaaaaattaacggattagtaataattcaaccgaagagaaacccaaggcaccgaagaacacgatttcagaggtatgatccggaaaaaaaaatccaaagttttgatccttttgttttttggtgagcaaaaaaactggtcctacgctagtcaatggacattctcctaaatttttgtctctgtttttttagattgtaaattataaagtaatttctccaactttctggaaaaatccatccagcaaaagaaaagaataattggttttattgatcaaagatcttcagttttcaaaattaagcactaattatggggttttgtttattaatgtcctaaaaaagagttacacatagagagacattaatgcttgcagtttagtttaaagagttttaagaccatatctcactcaatccttatttccttacatttgtcgtcttttgatgtcatagactcagagatatttatttatcttctttctctctcatttctcattctcatatttacttttgatctcgtggtgttagaatcaaagaaaccgcttcaagg

SEQ ID NO: 4907 - DNA, 672 bp, Arabidopsis thaliana
cgtctctaagctctcccatgatttggtcattagtagggatgggaggaggaggtggtggagtaacctcataagaatccaggtttctctccaacgggggacgtcttgttctcgaagtttcagagctatcatttctaggactgagtctatgtgtggctctaaccctccattgaggagtctgagaagaatctcttcttggcccctctctaataggatcctgatatcttgaggtaccccttttgtctcctgtctcatggcgacctaaattccttctgttagggttaaaaggatttctgtgtcttctctcctcatagggtccagctcggcgagatagatgttctctagaagttgaggtctactcctcttacttttccaagatcttgagaacgactttgattaatagaagggtttcttgaaggcgctcttgagggagatgattctcttagagatctaggggctatgaaattgtctctaggagtgtaataatttctagccagatccttggatgcctcttcacttctggaagatctgaactttgtagtgtcctcattttctgaaaccagatctggacagaatttcttttcatgagtaagtcttaggcaatgtgagcagtaatttttgagattcttgtagactaacgagatcagagcttcgctgccatcaggaaagtctacc

SEQ ID NO: 4908 - DNA, 2000 bp, Arabidopsis thaliana
tatatatatatatatatgggaaaaggaactattgaatttgaagcaaactgttgagcaacacatttaattaagtaagttttacagagttattttgatcatcttaagaatgatagatataattagttaaccgaatttaatcactttaatttaatcattattacgttgtatactttgtatttggctatttgctttgttcgttccaaaactttagtatattcaccacacttcttcaccttatctcgttagttttgctttattacctttcctctttctattttttttttattgttagggtcaaagctttgttaccctttttatcattcgatatttgtatatggcctttgtttgatatagataacaattatctacattggaaagatgcgtttgcgagcccataaaaattggatagagacttgcacttttggatgatatctaaattatagaaattagaaagtcaagttgccaaaaacttatccctcaaattccattggatcggtatcgaacggtgtcgtttatatcatctcgaggcaatgctgatattagccgctttctcgctgacacgtgtccagagattagcagctcaaagaatctagtgactcatctttcctcttatcatctcgttattacattactaccctttgcttgctaatgtttctttacgtgcactggaagaaaaatagaattatcaaaccaaacgactaatgactaatctatgatgcatctaaataattacaggacacaaagttgaatattctgatttaacttaaggaggtttattattattttaattaaaaattgatcagatgactctgtctcgtctttcaaaactattacttgttgataatgatttttctctatgactaattcaaacattttctatattaaattcatactttttaagttaattactcattagggcctattattagttatatataatgaatgttttaaatatagggagttgaaattccatcttaatcatagttggatttctttagttaggtgagtttatgagtgagttttttttttttttttttttttttttttgtctttcagtttggttgttaaattgttaattatgattaaaacgattattatctaaaaatattatttattatactatattggatgtatgacctcacttcttaaattaatccaattgctacacggcaagaatcaaacaaaaataatatgtgaaaaacttattgttgtgagatcatacttaactatatagaaaagaaaatgttagaatcaaataatttaagaggataaaaagagtagttgaaataattgattgtcgatatgcgaccagtacctaaaaatattagaattatgcatgctaaatattgtctgacttgaaggttattagtagtaatagattttatgtgatatgtttgcttaaaacaatatcattaataagaattaaaatcatgacaagggtaacgtttgccacgctagtggcagacacgtagaattaaaccgtacaagcataaatccttgtattagtctcaaaaccatccgggtaaacataataaaagttcattttcttgccatttctacaagcaattgacaccattattacctagaatagtactatttaatatgagagtttaaaagacccggaattttaaattttgatgtacggcattaatgcattgaatcgtaaagtatattactcttgattattaaactaaaagtgagtcatttggtatcttaatgacgagagagatttaactaatctcacattaaactaagcttaaggatcaagtgggggcaagcgaatggcataacagtaaataaaacgaaacacgagggctttatttgacaatgcctctaccttagcttcaaaactgagctcgttcttcatcatttcctgaaaactagaaaacacagtttaaaggaacataaaaagcaactcttttgagagatcacagaaaccctaatttgctaagaaccctaatctcaatttccatcttccaaagttcagattctgtatgtaa

SEQ ID NO: 4909 - DNA, 2000 bp, Arabidopsis thaliana
aaattattcatctccagaagttgcgttgcaccactaaatatgaagagaagataaaaccgaacaggtaaaagggacgtttaccaaaatatcaacctaatcttcccctaaaccaaatttttccaattaagtttattcttaagcacaatcaactctctgttactttaaagtattctcgtgaccactgattgtttttcctggtgtataagtaagtaccacaaaatataagaacatgacataagactctataaaatatgtataactaaacatttttcatttgtagccagataaaagaaatctatgggccggaagtcgtattatttgacacggcacttttggttaacgtataaactatctgattttataagctgtcaaaacaaaaaaatggtaaatttaacattcataaaatatcatgatgttccacaggtcacatcagtgaaagactaaactttctgattttttgtaaaattgactatgaggacatgcatgaattaatattctacgaccacaattacttctctaatctggattgaaaaatggccaccgtatacatttctttaaataacgtttttcaaattttattataaaatctaggggactaccatattatatgtataaacgtccatatccatcttagaaatgttatcaataataggtctgaaaaatttcatagaaccacacttattttggagctgaattcaatcccccaacgtactttctcgttcttgttatgtttcgttgtcgctttgtttatatttcttcttattttaggggttttttcagttcgattttgttttgtttttagttagcggacgaaaatatacagatggtagtactaacttttctcctagcattctcatctatgtgtgtgtgttatacatttatatcggtgctcttggttgaccttagaaggtactttatatatggttcgagggtccatatggataagttcagattaaacatctaaaagtgcatcttgtgaccaaaaaaaaaaaactatccatatttaaatgcaaaaagatctttggatgaattattatgacacaagcaatcgcgatagaataggaaaataataaaatgcatgcatcctcagcattggttgctaaatttccagttcgattttcaatttcgaaaggtgggctccatttgtttactagatgtgtttttttctttctttttgttgtgaatgtttactagatatgtttattttcaattatttgtatacgtgtgggtcgcaaatgccgcttgcgtggtacacaaaataatatcaatcctttgagaaaattaaaagtcaaagtgcataataatatactcagtatgtttttttcctttgcagatattccatgcatatgctaaataacatcatttatatatcattaaaaatgtacaacaagaaaccaaatgcatatgctaaaccaatccatataatatgttttgcaggttcatttaaatcgactaattatattatggttttttttttttgcttctgatattgcatctaaattgttgttgaactcttttccgccaatagaaacaatatttcaaatttgtagcatcgctaaataaaatacataataagttgaaacaatatagttgttgagtaaattatataatcatctttgctattgttaattctaaatttatttaacacaaaaagctaaccattaagcaaagaagaaagtgacatgatgatcgaaaggaacattagaaacgtcctcattgtccgccgggaaatattttggagaaggacatcgattaatctatagattagaggacacctcttagtttaaataatgatatcgttatacacctaatgaaattaaataaatgctcaattcatcaataaataatttaatgtgtgtttcctaatactcggaacattataaccaccaatcaccacctccaaacttccctatataagacacgacacccattctaagcatcactagctctctccctctccctctccctctccatctctctgctcgcttgtgacagtaaac

SEQ ID NO: 4910 - DNA, 1177 bp, Arabidopsis thaliana
gacgcttatcggtttttgcatctgtataagcaagctctcttgatatcaatatttggagcagccagttttcagccatttggcttttgtttttggtgagttctttttctttattttttttctgtttggttggttatatgtcgatgaggatgcatgaatacaaacagtacttgaggtttgctggttacagaccacttgtttgtttcacggccaccatataaccttatctatcgcaaactgttttaaagcatgtaaattactaaccaaaattaattgcatcgtttagttttacaaatagaaaagaaaaatcaactaaaaattaatgactttgccgctcatgtgtttgcacattgtgtttctgtgaaaatcaaaccgattccttcgtgaaaatagccgtgtcttcctccagatcgtgaatttggtacttcatacttaccggtcaaaagctcagaagcaatatttcagtcatggcgaaccgtatagtatatatcaaggaaaacctcataacataaacaaaggttcagaacttcagacaaaacctgttttagatgacagagtcatggatcaatctcagcccaacaacattaaaacttttcagcccatcaaacccaccaagtttaaatttcttttctctcttgaatcttgatccagtagctgatccgacaacgttttgatgtttggtcgaaacagttgaagtctcttcctcttaaatgtgattatcaattaaaaaatattatttgacccaagatacatgggtattgggcctccaaaagtttaagctttttagtaacaaaattaggcctccaaaaaaatttgttattgcaaaactatatcctatattctaaaattttaatatttagtctccatttttaaatttatctattttttattttctaaaagttataggatttagtcttaatttttaacttttatcaacaaaactcattaaagaaaaaattattttgtattgggccttatcaggaccggcgtctacaaataataatagacaacaaaattacacatacaatgaagatgttttattggtcacgatttgatttggtatttattctttaactaccaaaaaaataagtaaactcaaaaacaagaagggaggaaccactttaaacccttgtctacgctggtccgagtccagagtcctctactttgacagtctccctcc

SEQ ID NO: 4911 - DNA, 517 bp, Arabidopsis thaliana
aaacttgtttacgtttctatcaagttatctcggattcttaatgctttgaaactcttttgttgtttggacgttcttttttcattgaattgttgttgcaagctttcatgtttgttaattattttccttttgaataaaaagccttttgactttatttgttctaatcattacataaagttgaaaattaccactaatcgatgataaacattgaccttcagaaacccaaacagaaccaaaaaaagatttgtatcattatttaattgttgatccgccgaatagcaaaaagtcaaaaaccacgtcagagatacaaaacaaacaattaaaaaaacactatcgcgtgagattcacacgcgccgcttcgttgattcgtcgtctgtttacccaaactagtagtatcagatttaaatcacacgatcacacgaaggaatcatcatcatcatcagaaattcagaattcaggagcagtaattaaaattgattattttgattataaaataactcaagagagatcacagagagat

SEQ ID NO: 4912 - DNA, 763 bp, Arabidopsis thaliana
aagtaataaccatagctacaaaaaattctctgcactcttagagtcaaactcttctggttgaatcagatagaacttataagtgaaaatttctcctacttaaaactgaattggtttccaatgatgttactatgttgagacatagttgaaagctatttgcttcccttttgactaaaaatgtcaatggcttttgtttctcttctcttactcttttagtctttagagttttttgagattaatattggtgagatgtttgtacttttttgatctagtttttcttatctcgtgatagatttcaaatcctctttgtcagtctttgatgttggattgaaagtgaatttatagatttttaccttttcgaatttaaatattaaggtgactaaatactgaagtggtaggtcggccattctaattctgagtactagttcaactattctgaggtggtaggtcgaccattctaatactgaaatggaacgtgtcacttgttacttgttcttattgagaattgattttttacagggatcctaattaccacggatttacttgaatgagtttagtccatcaaaaagttgaaaaagaaccaaatattaaaagatggttggtgtaacctgtctgcttatataatccacgtgtgaaaaatgcataaaactcaaacgacaacattttgaaaacgatggcaaattcttgaatgattcttctttttatgttccctttttactaaagctaaaaggattcattagcaagtgtttgtgaaagggagagagaa

SEQ ID NO: 4913 - DNA, 246 bp, Arabidopsis thaliana
tcaaaaccgcagatttcttaggataaacttgtcaagtaaagtgtagaatacttcaactttatattcttcctgtaatatgattcattgtttagcgaatcagatttatgctcgtgttacttgtgtaactcgttactatcactatttattgtgtggtctctgttaaccacaaatagatactttaaaacattttaaagcaaaaagtcgcatctcctaaatcaatcaatcacacaaaattgaatcctaaaa

SEQ ID NO: 4914 - DNA, 1155 bp, Arabidopsis thaliana
tatgggcctgccatttagctaccgactttgctatttgttgtttacgtgagaaagtgagaaaaagatttaggcaagattcgttttttacattgatcatacgagatcaaaaaggaaaaacaccaaaaccttgatgaagaagtaaaacagatgatgttagctaaaccgagaaagtaaaactatcttaaaccttgatgaagaaggaaaaacaccaaaaccttaatcttaagtttcaaaaagaaaatcaccaaaataacttaaatgtaaaaaggaaaaaaagcaacaaaccccatactccatatcattcagccacaaaatatttgtataagcgaaaattgaagattgataaaagttaaagggtcaaaacttaatttagaagaatgtacatacaataatacaagggttaccttttacactatcaaaaaggttaaggggtcaaatttgaaggaacagttaaattaaggtccaattattgttatttaaaacgctgcgtttagtaacttgctctccaaggagatctagcttgttctactcgcacgtgattataacccattcataactgtatatagatatagacgtcgtccttgtgcttgcagagaaagataaaaacagaaaaagataaggaacttgcagagaaagcaaaaaagaaagaagaagcgaagaagagaaactaagattcaggtaactgcaagctttgaatctcttcattaatttcttgcttatgaattacttatgatcgataatgaggctggtgagttctgtttcactgaatccgcagcaaattttgagaaattcgttagtttttgtttgaatctctcttaggaatttggtcgaacacttggtggatatcttgtttattagtaaatcgttttggaattgttgttttttgcttcgattcagtatcacggggtgtttcttgctaatgattattgctttaattttcttgctgggcttgagctgattattttggttgttgagaatccgaatggttttggttagatgttaggtgaatttgtttatgtttgtgagactttagggttcttgagacttgagtttgattattggattaacataactggttttgatagatgtgaggattgctttgtgtaatatcttaattggatcattcgtattcatgagatttctttctgttttcag

SEQ ID NO: 4915 - DNA, 459 bp, Arabidopsis thaliana
cttcttcttcttcttcttcttcttcttcttcttcaagtgttgatcgttagggttaaaaaatcagaactttggatatcacaaaataggaagttagagaggtattggatattatatagaacgtactagaaactttagagaaaaggaaatagaaggaagtttacttttgagccaaggaaactttatccaaaacaaaatcataatctgaccaggatattgcaataaggatacacacatagatcttgttgttgcttcattaattgcgttattctcaagttacagctgtgaaattaatttattatttgctgttgttaagtttaattttatttttgggctatgttgcacttttataaacgtttggggatattttaacatttagtagaaatagatatgggtatcgtcttcgagttcgagatacacgctaaaaggaaaatctgtggactttgatgagcttttacttca

SEQ ID NO: 4916 - DNA, 2000 bp, Arabidopsis thaliana
gttaggggagagacaaagagtgagagagagagagagatacaaaacagagaaagaaaaagagttaggacagagagagaaaaaaaaaaaccaattttatttagtccagcaaaaataataattaattttaaggaaaaacaaaatagtggtggggaccacttctacactgattttaatattattttaaaaaaattgtctaagataaaaattatattttgtgaattatgtgtatctcatttttctttttcccatgtgaagcagtgtacttgttaacttaccccacatttccccactcatggtagtcaataatcacctgtttcgcggaacattccaagagtttttattgtctatgttgtgatgtaccatacatagtaagtgttggttgcgacttcttgggaagaaatcgagtgttccgtgcctagtgaacaaccgcggtaaccgctagttgacaaagaaagtgtcggtgtttgtaaacgcgctttgactttgactcctaaagatataacaagttttctaattgggtcaacctttcggtctccatgtggtcattatggtctgggctttcttggcccactctttttatttggcccacttacataaacccgcttttaattttttattataaaatagtatattagatttggtttcttgtttttatcctttgatggcctctaatcatttaatttaacgtgggatattaacattttgttttgttagtgtgagtacaaagaaagagagaccagtcacatgatatgatgataaactcgaacgaagaatccaatgcgccacgtcttccatgttcctcgtcttggtagctttagaatctcaatggatctaattcctttcaattatataatctcattatcgtccttaaaagtatatattattccacattttaaaaaccatgcatgatgctgattattattggtggtatgacattgatataccttccgttcaaactcaagccccaatatgtatactgaattaggaaccgaataaagagacaaatcataagtgtattaaaaggtattaccaaccgcagcggcaaagttccggctaataattcccatatataatctatttaaaagagaaaatatagaaacggctaatcatgatcatatggttcgagaaagatattgattagtgttaaaataatgtagtcaccaaattaaaagacaccatgattcgtctcgaacatggccatattttgttcacatgcacgataacgactcccacatatacgacccattactcaccaaaccaccctttctaatttatttctattttcttgtctttttcgtacgaaagcaacgagatttcaaaaggtaacgcggaaacataaactgaatttaaaaggtaacatttgaagtcttttttcattacgaaattctactcgtttccttttaagctagtattggttcttacacttttatataaaaaaatgcatagaaacgtaacgtaggatgcctagtatttgactatacgtattaattaccaagtcatagttaatagttttatatctaaaagatatggcactaattaacaaacaaaggaaaatactccatatagaaagcgtcatttaagaaaattattatgattgtaattattatatcatgtaagacaaaaacaaaatgaaataaaacgatgtggcaatctggtcgttggattttgggtcattgtcaaataatccaacggtgttaatgtcgacacgctggcgttgaaaatccagtcaaacttgggagagctaatcactcgtacctataatttctctctaattaagctcaagacattgattgtcatttgttcttcttcactctctctaataattctccagaacattttgcacattccgtttcactccgtgttgttggatcccccaaaggtaaaacctttttccccagattatttctatttcgttcctctcttctcgatttcgactgattttccgtttttatgctcttctcttttccattttgaactccaattttgattctttaaagaaa

SEQ ID NO: 4917 - DNA, 1643 bp, Arabidopsis thaliana
ctggacccattatggttggttctgtcgtttcagttaaactaatattacatctgtattgtggtaattaggagagaataatgtgatgaatccatttctcacctcattttagaacatacatttcggtatattgcgtctgtattgtagtaattaggagagaataatgtgttgaatccatttctcacctcattttagaacatacatttcggtttattgtataagcttaaattagtaattgaaaacgacatacactatctattgatattttcactgattaatacgactgtattttttatatttcttaatggatgttttgagcacaatttagtaaatatgggccgtagagatatgctacttcgtcaaaatgttaaaacgtctttgagatattttgagatataatagacgataagacaacatttatcttgcttacttcgatctattgtatttatttgtatttataattgaagtttcaccgtacaaatactttatatttatcttaggtttataacaaattaattattccctaaagttttaaaataaaatatttccctagcgagctagtgggatattaattatcatactcaaagtagtcgattatagaaactaaatgattaaaattttacgtagtctggctctgtttttatctcaaatttctttgcaaataaaaacacaataaatcatatttacttgggagaaacttctatcacatattaatatttatcaagaaaacttcaatcatatttttcgtaaagtgttacttacctttatacaaatattccgtgtattcctcggtttacgattctttatgtctgattgtgtggaaaagtacaatcgatatttttgcaagaagttaagaagttggcacttggcagatgcgtgacgtgaatgaatcgtcaaggcagtgactctccaagccccagtcttcatccatttgacattttcgcatctttttcaagctagagaattttaacttaagttctccattgaaaatttcaaactatataaataaaactccacatatctcactaaaatctaacacgtgacaaaaatttaattacttaagtgtagtatatgttagtaattttctcaactcgcgagcaaacttcagttaacttgattttgataaaataaataacacatcaattatctgaattctttttaaaagaaacaaatatttcatagaattagtttttttttcattttagaattctaattgaatattacagaataaaaacttttacttactaccacacaataatagactttaaagttagttattgtaagtagaatgtattattttgaagttaaaatcgtgtatttatcgtgatgtaaaaatttaccgttctttcttataaactagtcaggctattctggtgttgaactacttcacttcacacgtgtcttttggagaagtagtttcattaataaacacttatctttaattttggcttcaacttttcaaaggcacataatgatcacactgtactgtatcatcttatctcataaatgagaaactcgaccataagaactgtctatagtgtgtatattcagaaaagttatcaatagttcaatactaagaaaccggcctatatatatatatttgtggtcactaatttctccaaaaaccagttgccttccgtaaaaag

SEQ ID NO: 4918 - DNA, 1491 bp, Arabidopsis thaliana
acacgtatatatgcatatattcatgcttaaatttatgtgattaattagtggtttcactgcatattaattcatacaagttttatatgtaacttatgttgagggagctcactccgttcatgccttctaatgtttggacgaagaactcaatcttttatcttatcggataagaagttacttgtgttcacatttgatgtttgttcgtttccaatcgtattgtgacttttgatatataaaataattattgtatatattctacttatgatatatgattatatagtcatgtaatgatgaccgtacgattttcaactctagtatccctatctttagggggttatggctaaaagcctaaaaagattacttttgctaaaggagtaaagattatgttcataattttttttaatttatataaatttattattattattctcacgcataacacaaaacaaagaaagaattatcttcataattatatatatatatatatatatatttgatataaatttattattattattattctcacgcatagcacaaaacaagtttcttctatatatcaactaaactaaaagacatgtcgttggaaacatactcatatatcatattcaaggactcataataatagacatgtaaacaaaatattccttaaattttctaaattcaaaaacaaactatatatgtaacttgttatttaatcttcttgggtatataaaactttatcgcatttcttggatatttggacgatgagaattcaaattgctttgtcgatgataaatttgtttaataattgttcagactgccatcacaacatagctgattactgtcatataagtcatacatattatatttccgatgattctctggactctcaagacaataataataaaaattcagatataagtttattaaggttttctttgttaacgtgtttactgtctagggacaaacataaattattagcactaaacttgttaggttttgaaagtaaacactgatttatacctaaacttaggttattcatgtaatcaaatgtgaaaactaacgtaatgaaattcctctagttatttaaatacagaaaacaaaacctaccttgcggggaaaagcatcgtggcgcgaaaggaaacttcctatgatccgtcatccgtgccgtctcaatttgattggaccacgaatctcgcactcgatactgacgccttacgtggattactttttttatagaaagaatttaaaattgtttctgaagaggcaggttttgtgtataaaatagagaatgcaagtaacgtgtaatgacattatttctcaaattgaatggttttcgagcatttttattaaccagtgaagcaaccaaaacaggaatcaccagttcttgaaagagttcatcaaaaaagaaaacatttcttgaaacatctaagaaagagttttgttcttcttgatcagaaatacagagcaaaatccatttgaagacatcaaagtttaaggtttttttccccggat

SEQ ID NO: 4919 - DNA, 1098 bp, Arabidopsis thaliana
tctctcgactaaccaccattcctttgcttttctgccttccttggaatttcgcatcagtcttgttttatcttgaatattacgtgtccgtaacatttcgattaagttgattcctctcgtgtttcttcaacatataagataattataatattatttctctcgtgtttcttcaacatataagataattatactacatggtctaaatttactacaaagatctaaagtcggagtctgtctagaaaaaagtcctttgcgggtctattaggaaaatcgtaagctactttttgtcaacatatgcgttacttgaatttttatgatgtttttaaagtacaaatttagtttaaggctaattattgtttcaacacactaaaagtcctggtaggctctatatacacatcaaggtcagattctaattttaatacaaagttctaaagtcagaattcaaatttaatacaaagttcttttggtttctattaggaaaatcttaagctactaaaatcaacatatcgttacttgtgaggttaactgttaaaccaccttttgcttaccagtaaaccctattaaaagaaaatagtaaaacctaatgctggtaggttctagagatacatcaaggtcattttcatatcaaattataccggtaggttgctttgttaacgggtctattatttgcttcttgaaagcaaaacaacacataacttttacatgtatgttaactgtttatagatcctaacttagcaagtgaaatgatatttcaagtggtgccttggtggaatgttaaattgtgataaattaaagatatttataagaagaaataaaaaacactaaggttgtttctgttaatagctaaactataggactaacattaaacgttaatgatgttcgaagttttctaacgaagagaataacagacacactgaaattcaaataatctctctctctctctctctctctcactatcttcgttaaattcggcaaagctttcgctttcttatttatggaaatttctttcatcctttagtttagtctctctctctctcccttttttgtcaattcagagacagagaggagagagagaccaagaaaaggagacttttgttgatc

SEQ ID NO: 4920 - DNA, 2000 bp, Arabidopsis thaliana
tattttaaattaatagaaattaaatatttatgtgcaccaaaacaaaaacttacaataaaaatgacaaaacaaatccacacttcatcgaaaaatgaaaaatctgaatagcgcctcacacgatttattaatggtgtagtcactctcacatcaatgtttggaataaaattgcaactagtagtttttcttttcttagaaaagtagtatttgataacttgttccccaagtagtaaattcttgctatagacaaaagatatacgtgggtaggtgataaatataggaatatcattatatgtcaggaatgacgtcagaatcgttattggttcgataagattcattgattctgaaaaggcgcagaagaagtaatgcgagaccattccttccctggctccctggaagaaagaaaggtccctttctctgtagttttgacttttctttgttttattttgaatcgataatttaaaattcggacgtgtttcttgctcgtaaagtaaaataagcttcacgtggttccaacctagaatggtagtgcaaagatataatctgaccagaaaatataattttataatatttttagcttaacttacaaaataactaatgaaatatacatttatgggaattcgatttttcgtttgttttaacacatcaataattcccatcgatccgttggcaaaacgcaattatgataacaaagattactagtgaggaatgggttcttgcagcacttgtcaatttgtccatccatagtcacaagtcacaactaatgccaacgagaaagtcaactaaagcgatgcaagaaaatcatcataactcagcttcttcctttttttttgagatattgatgtgtatatgtacacacaaagacgtacatacaaaattcgagtttttatataaaacgaatcgttttaaacgatgataaggagtaaggacatatggaagctgctaataacatggctaattaactagctataataagagatcaaatatatcttatcactgataccaaaaaaaataaaaaaaataactatattgtacatatgagtgattcgcgggattatacagacatacggtcctcccgtattaaaactttatgttaaaataatagagttgtagttgaacaaaacagctagactaatcgtcgatcgctgtgatcaattcgttctttatatttttttaatgctataattaatcatcttggtcagcattagacaataatgggcagataaaatattgaaaatgttatcttacgtattatattgtattacaaacataaaggcataattcattttatatacacaagattccctattttataactacgccaattgtgctatggttacaatttaactttactaacaacaacaacaaaaagactatttttcacaaattttacgaagtagtagttattaatttcatggcatccattttctctttctctcaaacaagtcacagcttgttcgtcaagaaataaacagagcatatataaactcacatgagtccttccaaacttcacttacaattatataaaaatatataagcagagagagagagagagagctctctgcacatttttcaactgctgtttatacggcaagacaccaagaagccgctaaaccctaatcactttcttcttgttgcttttcgaggtatatatatatatttttatattctctgctttaatcatttttatactggaaactctgtactttatgttcttatctgggccgtagcttcggttattcctcattgtaaacgacagatcttgcttcaggtttcgttattttttcacatgttcttgaaaaaacaatatacagatctttagggtgttttcatggttggtgaaaagtctttgtttcttttccttcttggcctgacctttatgttccctatttagatatatactctctcttgaagatctcatcagctcatagatttagaaacttattacatatctcctctgttcttttaaatgcttaggatcgtgaggtatctgtgaaactcta

SEQ ID NO: 4921 - DNA, 2000 bp, Arabidopsis thaliana
ttcaggatattcccacggtgctcttgcagttgtgcccgtcgcttgctctcacccgcgaacggcccttaaatccaaactcatatgatttgatttcaaaagcattccataaaactgttttcttgtatacaaagatataggttatggcttgtaccactagcatccatattccgcaacatgtcaacgaagatttctatagttttaacacaatcattttttttgtagatatcttagggtgtcttcaactccacttaaattttccctctatatttattagagtaaaatcatttttaattccacactctatacatcattctaaaacacagtaaaggatatgattactctatatatatgtggagtaactctaatgtttactctattctttttagaataaaatataataaaatgatacatttgagaaaacccctactctattttagaattactatattctagagtaaaaaacatacattggagatgatggtcttttagctagataggatttaggagcttccgcttgatcaaaaaaaaaaaaaacagagagttaggagcttccaaacaaagttcaactatcgtgagtacattaactcattgcggatgttaatatatcttagttgtggctttcaccattatactcaaaataaaagaagtggagacactaagatgtcgactggcctatcaaatgttgaaaaaccatcaaaacaaagatcgagttgattaataattatacagttgtggcagattttaaaactaaccccacaatctattaaaacttgagagtgttccttggaatgaattcaacatgtgtattacaacacaatcaagaaattaattcggtaggaaaccatgattttgatgagacaataaacgattggatccgatcaatttccccataaatttttgcaataataaaatatgtcaaggtcaggttccataactaaaggaaaacaatatctgcatttctttatcgtgtttctccatcttgcatgaataagaagaattgttaaaaagtgaatgcataccttgttgatctaataactaaaaaaaaaaaaaaaagagaaggatcaactgatttacaccaaagacatcttaatttgattggatctagccagtagccacctctcataaaagtttaaaagactttctaaccaatagatgttgttttttgttttggttttaatgttaaatccaatagattttgttcttctcttgaattgtgtgatgtttcaacaagtctggcaaatacacagtggttcgtataattggacgatgtctaccctagtttgggctcatttggtttcttgttgaaatccagttttgggaactaaaaatcattataaaattttaacaacaaaattttcatatctagaaactaaataaacacacatgagaagtaagatttcaaaaatatctgtaattgagttagaatcaaaacaaactttacaagatcatgtgaaaaaaatatacatatattatttttatataagtatatcggacacagttgtaaaatttgagagaaattatttatgaaaaatcaattcaaaataatatatataaaaaacaaatagttttttcccccataaaatatcacgattgtatacaaatttgttgggcaaaaacaatactatgaaaattttcataattagataatttatttatgcaagtttttttttgttattgacttttttatttatttagaagaatatatccttatgaaaatcataacaaagaaagagagtttagttttgcctaaattaggatcaaataaaaaaacaaaattcctgacccataccactctacgacctccctcaaaaaaaaacaaaaaagaaaaaaaaacaataaaaaaatcgactttttagcatctgcttgagcgcgagaggttcatgattccaggaatctcgtgcccaattatatagctttccatttctgtggctttgtaatctgatcggaaatcgaaaacaaacaattttattttcttaaaaaaacaagatcgtggaggagag

SEQ ID NO: 4922 - DNA, 1374 bp, Arabidopsis thaliana
agcaaatccaagctctcctcttcccctttcgtttgttactttctcgacaatctttttggttttgaggagttgtcttttttcttttcttgatttgatagacaatttgtataacaatgcgattttgaggattatattaataagagtttcattgtgtgaagattctaaagttttgtaacatgaaaaaaaagtagttctcttagcaaaacacaagtgccacgagaatcggtttaaattggtctgatccggttcggtacggttttgagaaatttgtcggaacgtcgaagaataaaccagaagggtttagaattcttctggtggaagagagaaagtaatcagctgagactttgcgacggagtaggtttggtctttcttcgccacgtacgaaccctaaatcctcttttactcattttcctccatcttcgagctccccaaaaacctctgcttttgtcgaacctttcaaaaagtaataacctttctcttctctgtgttcatttttgattcgtcgattcttcgttatatcacctggagaaaatgtttctgtttccagatgtttagattcttggcttattttgtttgcactcattttaggtttaattttgaattgcttcgaggtttaaagcttatacctttggacggcgccaaaaacatggtcttccataggctatcaagattaggttctcgcattgttaaagagctcccaagaggtataaactatctcaatctgtttacaactttttggttgaatttgttctctgcttttagtaaagagctcatgtactgtttgcgtgatttaacttttgggcagagagacatttgtcaatgtgtggaaagaggattcttcaaaggtcttatggccagtatcttcaatcttcggttagtctgagctctctgaatcccagttatgaaaatttattgcattggttttatttctaggttgcattttcatatgaatcttattaagttcactcactagacatggcactttccatttacgatcaagcgttaagatatgagttgttaattcttaattggtcggctccgactgaattgtagattaggtaaaaggctaaaagcttgttgatactgagtttggttttgttaggaatctgaggagcttgtaagatatacaccatctttgtccgtatcatgaaatggtttagccagttatagatatgtgatgcttaatgataagatatgttcagcaaccaatagagagaattaaagggttttgctttggctcaaggtgctagcaaatgcctgagtctgttgcttagaagtgacttagctatgaagcttgggtttttggtgacttgcgctgttctcttacatatttgattttagtttaatatctttgctctttcatctcgacagcca

SEQ ID NO: 4923 - DNA, 2000 bp, Arabidopsis thaliana
tgattatatattacgtttatacaaaatgatcttgaagtgagggtacctaaaatgctaggttgatttccaaatatgtatttgtgttggagcgaattaatcagcgggttgttgaatgatcacatgaaatccttaagataattgaaggagactcaaattacacacacgcaaactcatccatatctgatcttagatatattatatatggaactaacattggtcattttgcggtcttgagcggaagagatgactcaatacttagtacttttctaagaagattgaactcaaaacagcctcaacgagctaaattatttttgtgtgaagatagaactcaaaattacatccacagaactgcaatctatttatatgcgaagagataacgcaacatttaattttagcaagctaaaattcactttccaattaaacgtaaactcaacacttactttcaacaaactgatatatctacttgaaaagaaaactcaacgcttgcactcagcgagcataacttctcttcttcttcttcttttttcttgtcgaggtaacaaaaatgtcacaagttttgttgaggagaagagtttacagtcacatcgggagtttttttttcccattaaatctcttttctttggaggtctttaatttgattctcaacagatacgtgatcaagttgtgaataatcaatttttttgtgaatatataccaactcgaataaaataaaaacataaatggacaaaataaaaaaaagtcaaaaaataaaattgtcattaattattatgtgtccttttttggtaatttatttttgggaaaacagtaaatattttattgtgtttaattatatagaagaatagctaatatttggaacaaaattgttcacgtggaaaagacagtgagaaaacttggatccatccatagtccatatatatgggtagtcttccttctttctttatttgatgtgttattcatgaccattttatatttgaattaaatcatataaaccatttgattctttgaccatcgaccattgacccctaaaccaaacatatgattttttttgggagtcgtaattagcaacaaaacggaccggctcgtgcgtgatccgacaccaacaccaacataaggtttttttttttccgttcttaacaccaacatagttcattcatatatatagggaatatacacatgtgggtgtgtgtataagtatatctgtatatatgtataagctaagatgaattaataagggtcctaaaaggagaatttcttgaccaactacacaaaataaacaaaggataaaatttggacgtgtgaggtttagctgcatgtaccttgtacttgaagacccttattaggtgagagcttcatgcacacactctcttccacattttcctcccttttctacataataatttctaccccatacaatagtaatgttatttaattatttataaacaatcacataaacactgaaatgtaaattatattcttacagcgtcttattgaaaattctatgtctttcaaacttagatggtaattgggttttctaaatatgctaacaaaacttagaattgataaatatgtgtatgtatttataaattaatcaaaaccgtgttagcgtaattgttttttaatcccattcacgataaagtaagaagaaaaaaaccctactctttgtcgtcttccttcatctttttcctcctaagaatagtcgcaagtcatccttgtctcatgatatataaataccatcaaaaccctaatctcataaaagttttagttgtctggtttttcctcatctatacaagtaagcccaatttctcaccctatacatatcatacatatatatcgatcttttactattctctcttctttcgaattcctcctttaatacctttgtcttatggataaacagttgtagaacgctaggatctatgtgaaacttagacttgttactatgtgttttaagcaggtataaaaaggttcttggatttggagtaaactaaagatcatataaa

SEQ ID NO: 4924 - DNA, 2000 bp, Arabidopsis thaliana
gtaattagatttaaataatggagatcctgaagattttataaccttttgttaatggtattgctataccaagactaattaggagttagaacaaggttaaaggcacaacgttgattttcctttttcttttatatagataaaaacactagtactcttaaatggtctttatgcacatgaaaacgtgatctttaacatgcatatctaattagtaattactgctttttttgtttgtcaaaaattacagtcttttttcattactttttttgttaaaggatttatatctaatttactgctgacatatggaaatggagtccattgtctttgtattatatatcatctttcatatatttcatacttttctttagtttaatatatttataccaatttatacatatttagatattctacaaatattaattttttgtcatcatttgttttatattttataacatttaacttattaaggttaaacgcaattacaaagtgtaacttagcccgtcactgatgagctcatttttacaagcaattaagcccattaagggtgtaaagcttaattccactaatggcccattaagtaaaaagcgctatagtattaggccttgttcgagaatctcctaatgccatgacttagacacaatctttggacttgacatcaatacatcatctctgacgatgaccgatttcctttggtaaatctctgacgatgaccaatccagaagagaaacctaagagtagatagaatgatgcaaaaaagaagtgaaaggataaccccacatcacatctctttccatgtgtcaccttctgcatgaatccacacattgctattttaagaaggtgaaaatattttaaaatgtagacaataagcttcggtgtgaacttcggagaagcctgtggttcttgtgataaaggggatatcgaattcaaagtttgttgcactgctttccaccaacaatttaacaaacataaaaaataaaataaaaaagtttcacttcttttgcaattttgtagttatttaatttgctttttgaaatcgtctaagtagtgccaacgtggatggcttgttcggagagagccttccacaagcaattgaaacttggaataacgttgcataagtaaaatgttgcaatcatcaattttaaaagcacaaggcacatgacattaacacgttatttgaaagtttttttgatgagaatatccaactactttaccgtcctcactctcttaacctttgaaactctaggctttatgttccaaaattcaacgtaacatatattctcatacttaatttttcaggttttcttaaaccaaacattatgtaaaagtcaacttacctatattaacatgcaaagtcaacatctctttttttgtttaagcaaagtcaacaacttaacccacaaacaaaaagcaaaacatgcaaaattattaatgtgcttcactctgactctcaccaccataaggtaaacataaaatactctcaccgccgaagttacccccacaaggtttctattttaatctcttagttccattactttatctacattaacatacaaaagaacattctatcactccaaaatatacgcataaagatattattatttgaactaacagaatctaagttagatagatagattatattaaataccatacatactatcacgtggatcgtttctagaatatacagtaaaaaaaaaacgttaggcgatatgtagtctaagcaaggtttataaccttttgtatatttcaaaggacgtggcatattaggtacatgccaagtggaattgaccttggctctcttctacattgataaagttcttcgcataattcacatccctatataaacaaatgaacggagaaggtatgagtacatccacacattgacatttctaaaatccaactcctctttttgaaaattaagaaactccacttggctcttcgattttttctatctaaataacagaaccaaatcattatcgaaatttaaagttgtgcgaaacaaaacaaag

SEQ ID NO: 4925 - DNA, 2000 bp, Arabidopsis thaliana
atagccaagataaagaaaacgaaagaacaattcccaaataaaaatcaaccgttgaagagttcaaactaatatttccaaataacttaagaaacttaattcatatatgttggtgtcggatcccgcaccacgggctcgggacctgtcaaagattgccacgtaaagaggaaaggcccacgggcctttcttgagcaagaatacaagcggagtgattgatccgcgaggtgaatgtgacatcgaggtcaaagctgcccggattggagagtcaagtggaccggaagatagggcccaagaagtccggaatcaattcaaattcgaacatttgaatagttaattcgaatactgaaacggatacatttaagacagaataattgtgtgtaaataaaaattaaatttatttattgagtataaattatgggccaaaggccatggaaagacacacgcatttttgtgcaaacttactatacacattttcttacaaaactcatagttttctctataatcgttagttcattttcttatacatttgtcctcaagtataatccttctcactaaataaataaatacttgagtgtgtgaatccgacatccacaatacgaaccatctcccttcatttttatgaagcttattattgtttttttgtttaagattcttatgaagcttataaacttgagatctagctctagctcaaattcaagaatggtttagggccgccttagaatactttctaattgttaaaaccctaaattagtactttaatttatatggctttaataacaaggaaatatagtaaaaacgatacttttgtttttgcttttggcttgaactattgacaatgacataggagatagtgcacttgcaaatatggagtataagaaagagttcttattaccacacacatccaccaaaataaagacaaaaactaatgggagtgttacgtcagtacatcaatcacctcttcactcaatacatgtttgtttaccccatatggtcataaccaaaggcccaaaatatcaacttaagacatagttctacctcagtttaatgaatcttaagaacactatgccaactgcggacaaaaataaaaaacactatgccaataagagagaagaaacatgtaccttaaaagaattccacaagtttattttgtacttgtgtgtgtttggacaatgtaaaccctcaggcccaagagagaagaaaaccacaaaccgccacaaactcaagatctaaagcaagtatctaattcctatctcaggtactgttactagatacaaaaactcacttatcaagctcccacaacaccattcgacttctaaagctgtccaagctttttgtctgtttcttcttctctctttttcttttctaagcttcaacagttgctaccaatataacccttaataaagtcaagagacacttctctcatatcccccacaaaaaaaaggtgaagaaagatctaggggtcttaatattatttttaacacccatagaaaatttatattatgagtttttctactctaaataacaagaaactatagaaatccataccttcttctttttggattaatttaagagattttgtatatccatattcgagatagtgcctgccaaagaatataagaaagagttcttattatcacacacggcataaaagaataaaaggcagtagaattaatgggagtgttacatcagtaacaccaatcacaagacactctttaacgatcaagtttttttatataatggccttgtgacatcacaataaagagaccctacattctcaataggataatccctcaaacatatggacactaaagatcggaataaagataagaaatcattagagatttaatattgcgagtgtgatatcgtgtagacacagcacagtgttgaaatttttaccttataaatatagtatccaaaggatgccatgatgaatcaagctgagaaataacttttttagtaacacgagagagataaagaagagctaaagagacagagagatgaaa

SEQ ID NO: 4926 - DNA, 2000 bp, Arabidopsis thaliana
aaactaatctaaaaagtagtgaggatgacttgaaacttaagtcttatatgaattatctttaaatatagaaaaagaaaggagatagagaggtgtgtttttcatgtgaacaacttttttttacctttagagtacttccagaagacttattgggtccttaataaaagtagaccaaattattgaagagctaaaaaaaaatgcctactcaaaatatccaaacctcttcttttagccttttgtttttttcaatattcatactaatgtaaactacaatcattgtatcattctataatcatatgaattttttgtcaacaccatgcattatgctagtttaaatttaggtgatgatataaagatattttaagtacaaatcaataggggcgatgttcttatgtctttatctaactttatgaatttgtgttttatatattatgaaaaattggaaaagaagagatggcctacgctcaagaccaattcctaccaatgggcaatggtgttgaaatctgaacaaaaaaatttcctttctttaacgttagctttaaagttcaaaaaactttatttactttttcagtgataattctgtataaaataacatataacaatgaggaaaaaactcaataatttgaatcgcttatgactttatttctccaagtgcttgacttttaaaaccctaatgtccaatctcaactaaagtcaacctttttcgttcgtctagaagagtcagtcattaagtttcaattgaagtatacagtaaattattagtactttttattttattttaaccacagttcattggctgtatgagatttctgttcaagaaaacatataaatcgaaaccaaagcaaaagacattatttgcttcggtttcttctactcaagctcatttttagtaaaactaaattgtattttcattttcttaaaaagttaattgttttttttgtaaaatcagttttaccaaattggacacaataatgaatatatgtctatgtctagttttttttagctcagaatatatcttatgtgaatagaatcgtctatcagatatttttgtgatgcagatagaacttaccgttatagaatcatttgtagattgttcatcgtgattgttaagattagattcccatttgtaatataacagaaactcgaaaagtacttatattaagtattaacgatgtatcatgtgaccaaaatagaaaatactacgtaatgatatgattattaagcgagtgtgtaggtaattcaaatatttcaattaatcaatctttgatatcactctttagagtaatgtattatctttcttattgttttaccctgggattaataagtttaccggatccggagtagaatttcttcggtttggcaattttgttcacctaccataacgaacttttacccttatacttagtttcaatctacttttggtgcatcctttcattttcaactgcaaagaagtagttaaaagatccaatacataatatatttaatttatcataagtaacttagtgtaaagaaagactaaagtactttttaaaatatgtatttgtatttcccgatgtgaaagaaaagaaaattgaatttgcacatatcaataatattagctaggaaaaaacttgtgagaaatttctttgacgacttgcgtgtgcaatagtcttccttatcttctctaccatttcttaattccactattgtatagtatttacttatgttgaattaataaattaaaacatttaaatttccctaaagttactttttgatttttgattttctatttttattacaactttcctactttttgacatcttttcttacaaagactttttgacatctccccctccagctattatatagtctccttttttcttttctgcattcacataatatttcccctatatagtttacacaacatcatacccaccaacatatataatcttgatcatagagagataaacagaggccgctatcaagaacaagactaagaacaagacttcactaggagtacaagt

SEQ ID NO: 4927 - DNA, 1304 bp, Arabidopsis thaliana
tgcggtgagagtgtggcgcaagtaaaaggctctttagttaataagatgtgatgaaattggatagctaggttacggtgaggtttttgggtatttataacgtacatatgaattgcaaaacttgaagatttaatttgcttatctcgtgatatcgtcaatgccttgatttctattggttgttgacatttttgagcttagattttttgtcttgtcgagctggcatcagatttttggtttggaattgagttgtgttagataaattagatatctcgtagcatcttagcatattggaatacccattgtccattgaagacgtgccacttgtaaatctgacgtgtttctatccctttgaatcgtatcagtctcaaggtacacgtcattggtgtttcccaaatagacatgtcgtcaaagaatcaaaacaacatgatacaaagtccaaacatacttagaacgttgcatactacccactctttcaccaaaatgtgaaatatgagtgaaaactgaacatctcaattttcattactctaagtttgttaattatcttgttaaaaaaactactctaaattacagaagatttaatcctgataagaaagtacattaaaatgacaacaaagtaaaaaaaaaaaatacagttcatcttcaaagacatgttttctaattcgtattggcaagaaaaacttaccagtcatatttgttgccgaaaacattcaacaaaatcaatcaaaggtatcagttaatatcattgtcgacggttttatattattaacttatgatcgtaagaacttcgtatcactttttgtttcatctaactgcattgttttacataacattgatatatatttgtttggtaagtgtttctagtttcacttaaaaactttgtagtttggcgttcgaaacaaacttgataagaaaaaaaagaaaatattattgagagcatgaagtggattggaattaaagaaaacaaggaaaaagaaaaaaatagattggaataatttcaaatatttctttccaataattcaagcatttatctttgaaaatttccccaaagtttctttgtgtacaaatgacaagtgttttcgttgcagctaaagaatctagcaaaagcttatggactagagagtgacacataggacaagataacgacaatcccaaaatctcataagccaatcactaaacagatacagatacttcacagataacaaaccttactcttaacattgctataaagtggacgtataccccaaccattttcaatcactctcaccagtcacaaccaaaaaaaagaaaacacaaaaacaaagattata

SEQ ID NO: 4928 - DNA, 2000 bp, Arabidopsis thaliana
catgagaagggagaagaagataatgtaagagtgaagtggagacattgttcaaaaattaggagtttagatttgattattgggtagtttttagttatgagattataatttggtggtgtgaagtgttgagtaagcttggaatgtcttgttaaagagtttaagaatcaatcttgtcatgtgcttgttaatattgcttattttaggtttcggtttgtttttaaaatttcacctttctttttagtataaagtattccaagaggactcgtggttttgtttcagattatttgaaatatttacatacaatatgtcaacaaacgtactattcttttttctgatattttacaacaaaatttgttctttaacatgttatctaaaaaccatttaacaaaaaaaataaaatgtatgagaaccttataaaatacaaaatagtaatttcagtatataatagttttgaattttcttttatttagaatttcgtttaaagggttgtgatttgtgaagtaatctttggaagataatctcaatgtaaacaacacattgggcttctcataggcccaatataaacaacacattgatcattatccatgtaaggtgaactctttaatcgaaaccgttcaatttcagtcatctcaatccaacggttagtattccaaggagcacgtaatccactctaaattcgtaaacacgtgatttctcactaaatataaaacttgatacgttacgccttcctatccatccgtcaacgattaaatccaatcgttcaatatagagatccaacggctaataacgaaacattagcccacacgaaatctcctttttttttttgacgggattatacagtgggcctccacctgtaattgtccatttaggagacagcgcggttaatttagcattatccctcctcacagtcatctctttcttcgcaaataaatgtaaccatctctcttctcgttttcttcaacaaaaatcctcatttctctgagaatctggtgctttagctttggtgagctctctttcttatgaaacttatcgattctcttctcgttgattgtcttatacttttagttctctgcttaatttattgtccttaatactcgtggatttgttcataaatcgttttctgagcagttaggtaagagttttgttaccgaatttcatgttcttcgattttgaatctggatgattgtatgatgtgattagtagactcgcttagattttgtgatctgtgtatggtttgtggctaattttggtttcatcggtggtatgaatttatttggggttttaggtttgtttgattacgtaatcggactgtttacttgaagatttatcgattatagttgtgatcgtttttagttgattgagaagaagaaaataaatttcatgctcttgttattgtcgcgattgtggcgattttcagtgtcttatgaatcaattatgttgcatgtgagtcttggtgcaattgagattgtttcctttttttactagattgcttgtcttattgaacaaaactttccatttatgttgaaaaggtttataggaacggatgtttagggttttgttgtaatctgggtatttgctttctgatttcggcaagcaaatgtcgatttcaaggtttatatcactttctctagcaaaagaagtctttagtcatttgcaaagtcaagagagtttttactttatttattgcttccacgctattgcttcgtggctgattgagagagaccaattaaactaataatttgtagtttgtacaatatattgcgtgtaacattgtccttcgttatctgtttgaggaggaggaccgagttagcctatttttagtcactttacaaattttcttttatgttgcatcattcaatatgaactctctgatataaatatatgtatacatactggttgacttttatgggtatggttctctgctttttttctctgtgatggtctcttgattctaactttctttgttttatgtttttggtttttgttgtcaatgaataggtaaa

SEQ ID NO: 4929 - DNA, 2000 bp, Arabidopsis thaliana
cagtactttcaaagaaatttcaaaacatttttgttttatcattgtcttgttaaatgttcttcaatactaaaataatgtagagtaaatttggaaaaatgcattgtttatgtttatacttttgaaaaatatcctcttaatgtttatactactaaatcttatttatttatgaaaaaatttcaaattaagcaacgttttcttatattttttttacattaaaaaaaaattctttcaaaagtataatatgttaggtcacattttaaaagtttgccttaagcgacaatggaccttggcacggcaccgagattcattgatgcaatacagaaaattttgataaagatactaaactatgataaaatgttgcacgttaatttgtgggaaatgagtagttgcaataaaagatatattttccaaagtatatatagttaaaactgtgaagattgtcatttatacgtgaaaacgtgcaaaactaataattgcgataaagacaaaaaccgaaatatgtagttgggattaaataacaactcttagtttattttatttgtttgtctaatatttaattttatttatgtgttgtatgcatatgacataatgattggcttaaattaaaatgggtgaacttaaaacttatccttatataaatcaaagtccctatgaccatttacgacatttcacgcttaatatgttgtcggttgaatagttagaatgtgggagtacacaccgaaatacacaccgttaggcatgactacagttacggttattacgattacggtttattaaccaccggttatggttataatttttttttaactttaattttaaccgttatatatacggttaaaacgattacgattaaatacggttacggttaaatacggttatagttacatacggttacggttatttgataattatgatatagttaatatataagacaaaatattatattttttaaactttataataaaataaataaatagtgatatatcaaataatatttattttacgtgattttgtgtttcaaatatttatagtgaatcagttatctatttttctttaagtaaaccaatgaataaaaaaattaatgatcataattataatgattgaattaattacattttccaaacaaaaacaatactaatgagaagatgttgtgaacattaagaaacagtttcaagagtataaataataataatatgaactacttataatttgatttatggtaaaaagagtagtggagtaacttcgatcatagtagtggacatattaaacaatttaagttactattttagtgaaataattatttatttatacactattataactatattttaaggttttgaaaatacgattaaccgtacggttttgatacggttacggttaattaacggttacagttagtatattttcttaaccgtaacagatctattttcactgttaacggttacggttattaaccgttttatacggttacggttgggttacggttaataaacggttcggttacggtccaaaataccgttacagttagattttggttatgcctacacaccgtaacgactatttttctcgaaaatttacttttaatgtttgatgagaaggtattattgtacaattataaattttaatataattttcgtttcgatacacaatataatctccaccaaaatctttttcatcatggctataatttagtttataattttacttacaagaaatgtttaattgatatcttgagtcaagatgagtctaattaactttataactatataagatgcatctaatatgttatataaaaaaaacacaacaaatgaacataactaaaagaaaatcaaacataacttgttaaagtactgttttaaaataaaacgggtgggtactcacctaattattttaaacctactcttgacactaaactggcctataaatagaacaccatggaaaggaaaagagacacacacaaataaagaaaacgaaaacacttttatacttatattgcagcc

SEQ ID NO: 4930 - DNA, 2000 bp, Arabidopsis thaliana
caattattcgcttccatctattctggtggttgctaacttggcatgacgtttttttttctccttattcacccttatccatttttttttttttttgctatgaatgttaatatcatatgatatgaacagtttggtttttacatggacctcaacctaataaaagctaaaaacaagaaatcaatagatttcagagttgggaaagtgtcaatcttcagtgcaccaaagactcataagcaccgtgaaccgcttgtttgatctttctggcattgattaaaattcttgatctatctttctggcattgattaaaattcttgatctctctatcaatttttttgaagataattgatggccaaatgagaatctggttgggtaggacgttttaacgctgcttccatatagcataaatcacaaattgggcaacaagcttcctctgagtgcgtggggacctgtttgttcttccttcttgtccaagaaacaacgcaaaccaagaaatcgatcgattgcatcgcaacaacttgaaatggtagctcataatcatgtgttgcattaaagaacgcttaaaaatattgtttatctaaagttacaccgcctagattaaaagatcctatataaattaatggcttttttttttgtacaaatgtaaatttcatcaaaaagaaaatgagaaagtatgtaatagttataaattagcttaaccagtaaaacattactcaccagaaaaacaaaaactagaaaccaggaaaaacttaggaaaatcatagagttaagcaaagttaatcaacgtcattaagttattatatataactacattctatataatctctgtttcgtcattgtacattttggtgactggaagtttttgtcacgtggtaaacaagaacgtattcgccaacctaaagactcaatcctctttgtctacaaattaaatacattatcacgaaaaaagctttatgtattataaccaaactactttattctctcaaaactattgcattggtgtgcaaatacgttttctcgagatgatatcatcaatcttaatatcaacttcaacttttaaagtaaagcaaacgtaaattaacacggtcgttctagctttgtagcatcgaaatagttttaaatgtcaaaaaaatgagcgaaataatttattcttaattatctttgccagatttttaaaaacctttaagcatatataattcaactaaaagaattttaactatttgtgactatctagacttgaagcaaaaagtcaaaaatgagtagacataactcaattcctgctgttgatccataactcaacaaatatgtgtttaacaatttttttttttggtcaaacaattctttcagtcgtaagctagaatattacaagatagatgagattaaagaaatagtcccaaatagcaagcaacaaaactaaaacattaacacaaacaaattctaaaatagagacacaaacttaacaaagcttgatacaatgaaacctcaatgaattaatactcgatatactaataccttaaaatattttttctagttctaaattaataatttaacctaaaaatatcacttctataaattaataattacgataatttaatgaaatttagtaaaccattaatctcaatattcttaatttatagaggttttactaaattgtagaaacaactaattcgagtacatccctgaattaataaattttagaaatgtgaattaacgaatacttttgttcttgtgaatggttaaaaaaagttacttatcaagacaagtatgaagtatcacgtgattaaacgtttaatgacaccaacctaatgacaatttgtttgatttatttgtcacctaactagagactctctcacagtcaacgcagcttatgtgtcatagtaagactttttgtctactatagtagaaagacgaatttataacccctttaggttttttctaacacacgcctctaatctccgcgcacacacacacaccctcacgaagaagaagaagacgaagaagaatca

SEQ ID NO: 4931 - DNA, 2000 bp, Arabidopsis thaliana
attgtattcgcagttatgtgaattttaatcaagagctagctgacctgaccgtatgcttattatagttagggtccattctctacaactacaactgtacatttataataagcatgctagtagatttattgtgacgatttcaagcacatagaagagtctatatcatcacttcacttgttaggcctctctttaatttcatattatatgacacttttttcattcaatgaaaagaataaaataaaattaattgtttgatactcctaattagggatgttattctctgcttctcctttgtacttttgggaatatctgtcaaatcaattacttaaatgagaatattaataaatttggcatttgatgtgctttatttggctgcaattaaacaacaatcatatgagttattgagtatcattccaaccccataaatgttagcctttttaaatggagtatatattactaccgtttttttgttcgtaacgcatattacaaccgctttaatcagagaaattatttaaagacgaatctggtgaaacatgaattaattttgtcaaatagaatatgtgaatagtatttctgtttatgttaaattaggcaataacattacatatatacttaatcctttatctgaaaacactagatttatgataaatacgaaaggtaacactggttagcgtatggaaccatcaaattttgactaaatgttttctaacactatgagtgaccaaaacatttccttttacaaattaaaatttgtattagtcatcctgcatacatttctttttccccaaacattttcaattttggaatttttttatatatatgtaaattacatttgaacaggtctaatttgaatggttaatacgcggttcaaataaagttggcaagtaattaacaaacgaatccacatcaaatttcaattactgtatgtaccaaaaccacatttataccaaaccgcatcataaaataaaataaaaattcttaaggcctgttttgtagattttgtaagagtttttggtttttgttttttaaaaacttattttcataccaatcaagattttaaaattttggtttccctacaatttagtaaaactattttattgtaattttccattcatgattttagttttttagtttttgtaaaatttaggaaatctagtttttgttcaatcaacgttatttttctcaaaaaccaaaaaccattttttggagattttttgaacaaaaaatataataacaaaaatctaaaactaaaatctaaaattcagaaactaaaatctaaactcaaaaactaaattaaaaatcagggcctaaattttgacataatatggatagatgatgatagtgagaccaaaccacataatattgcatattttgatgtcaccatttgatagcctataaaaaggagaagaagcaaagggtagttctggaaaaaaagggaatcgtgggggaaagaaagcagagtcgttttcagatcgtgaatagaagcagcagcagaagccgtatctatccctctctctctctctctctctctctctctctctctctctctactttgaccgttcctcttctttttattcatcaacatcatcgagctttctactacttggattcctacttcttcttcttcttcctctgattctctcccattccaatcaatctctagggttcttcttcaggtatctcaaatctcctctcttttctttttattgctaaccattttcatttactttggcttatttttaagtttaatcttcttctgatattgcgtctgcttttttacctctgcaaagacagaacctttctctgtctctctctgcttgtaccttgtaccttttctctctgtatacactccattgtctgccttttctcgtctctcttctcttacagtttttattcattaatttctctcgaggatgctcctcaggcccctctttatctcatctcccagctaaagtttctctttttgtttttaatcagcaatacttcagaagctggttttggcc

SEQ ID NO: 4932 - DNA, 2000 bp, Arabidopsis thaliana
gggagatggacaatgcaatccaataagaagatagagttgatagtgaagtgaacatgactataacaggttacttgactaaatatactttctttcatccgtttcaaaacattaacattgacaaatttttgtaagttttcgtacaattatcaaactgaaacttcaatttttggaaatattaagaatatgtccatttctctgagaatataatatcttttttggcgtgtgccttccacacacttcttatggctctccttgttttcttgtctcactcatgaaattccgcaagttcttcacgcaatcttatttatacaggaagaaaaagaagagaaaaaaaaatcttagcatctctacgaaaataatatatacattatggaatccattgactgacaaccacaaaaaataaacataaaactttaaaaattaatgttgaaattgagaaggagaaaaacaaacgaatattaatagtgttgtatgaattttgttggcatatataattaatcaagttggccgtggagttaatagaagaggcaaaaatgcatagatcaaacatgttttcttttttctttgtttcgaatatgttttttcgcataagaaataaatatgatgcgtcatttacataaaagaatatcgatcctttcaagttgttgtgtgtgtgtgtatctttaagtacctcttattatttgtgtcttcttccaatcttttatattcgtctcacatggattccaatttcatatacgtgttttttttgtcaacgtatatatcccatatatgctactctcctagaattcctaaaagctatattgagataaaaaaaaaaaaattattattctttctagatatgaaaatatatatgattgcgtgaagaatttgagagattcatgaagcatatcaaaagaaaacaaggagagccgtaagaaatttgtggaaggcacacgccatgaagagattatcttcttctgaaattcgcatattcttttcaaaaaatattgaaaactcagtttgatatttgtgaggaagtcttacaatttaattccaaagttgatgtttggaaacagacaaaggacgtatgtttttcggtcaagcaacttgttatataggttagtagttactccatatatatatttttaattactgtggttagttacactttttgtgttgtcgcaagtcatgcacatttctttctaaaagactaaaagctcttggctatatattttgaactgccccataatatagtaatggactctttatttctgtgtaattatgtgtttacatcatatgctacgtacagaaaaatgataaggcatcaaacttttgtgtagttgtctcatacgagttggaagaagtactacatggacacattcaaaccttatctcattttttatatacagaagaatggaataaaacaaacaaattatctcatttagctttcatgtaatccatcaattaatggagattatacgtttcatatcatccatcaattactgtacatcttgcttagtgtaatacaatatatccaataatttataacatttttggatctaatccatgttcacacaagtcatttttcataaccaggataattttgaaaatgattgtaaattttatagcaattaggaatgaaatttctataatcgaaaacatacactctaaacctaaactaaaaccttaaacctaaatcagaaatcatagaaactaaaccaatactgtaaacattaaactaatatcttgacttaaataaatcttttacttcaaaacctaaatataaggatctattcttaattagttaaacaaaaaaagaaacaaaaacgcaagtgtacgttatatagtatatttgaataatgaaatgttaaaataattagattctttttctagttgatgtagatccccaaccccacgccaataaatatccatccctccagtccaaacagttcacaccacccgagaacacacgattattctccaaagagaaagagaaaaatcaataacctcatagtgtcgac

SEQ ID NO: 4933 - DNA, 1288 bp, Arabidopsis thaliana
cgacaagtgatgttggataattcctaacttgaagagcaagatatctccttttagtagatggtagaagagatacaagaaaataaaatacaaataacgtcaagttggacataatttgtaactcttccttttcaaatcatgactaaactctaaatttagatgtaatttagcttagtggtaggtcagagcaaatggatttggtttatacgtttgcaattatgtaattccatggatgtagtttgaaagaccaaacttcattacaattatgtgtatcaatttattttgcttactcgtatctattttatcactagaatacaaagattttgctaactccaaatctattattttcagacaagcatatcctgtaaatcttcaatcatccaaaaagtgatgttgagtttagatccaactccaaaatgtatttatcttatttttaagtaaaaaactgaagaaatgagtttgcgaatcttttaaatagttattttgtataatgcatattagagaaagaacaaagataaatttttgtatcaaatatttaaactgagttaatggtggtttatgaagggtgttatagtgcattcactcccttatataatcgatatctctaatcccttggtaaaattaaattgttgtattgaatttttttatgaaagagtaaggtgagttgcaaattttgcttggcctcaaaaattcttctctctattttttcatttacatgtttgaagtgttactttttactttgctaagatatttcagtgttactttttaatctacatatttcattgttattttttaatttacatatatcaatgttatttttccactcagataaggtgaaatatttcagctaacttaaagtgattatgatcatcaacacctatttcatgtcaattttttgctaaaaaataaacaaattggtcataatgttcaaaaacttgacctcaccatcataatacttagtacttactggtcaaacaaacatatgttcagaacttttgtattgatggggaaggttacttttgtcgtaatgttacaaaaaaaaaattgttactgttgagaccattataaataatcatgtcatgttctttaattatcaactttgattgtcatttaattgtaaatttcgttagttaatctgtcctcttcttgtaattaaataaaaatttgtttcaataccaataaagttgtcctaaaaaaaaccacccctctaaatagggagtgagtgagagagagagtgatagtgagaacaaaaaaaaaacatcatttcttctcgcactcttcacctgctcca

SEQ ID NO: 4934 - DNA, 2000 bp, Arabidopsis thaliana
gcatcttagaaacaaagcttaacactaatacaaaaataaatattcgtcaagaacaagagtagatgacaaacaagctaaaggaggaggaaaacaactaagataactagcaaaagatagcatttcatactacaagtataaggtaaaaataataaaggcacaaaaatacccggagaaggcatttcttttgggtctcttcaggtgtctcactcttaaacttcttgatcatcttctcattctcaaaggaggtgtcgctctagtctttacctcatacattcttttgttcattttctctttcttatttttttttttttttcaactttcgtttaatgtggagatttaatatgtaattcttatctaaaagataattaactttttgcttatgttttgcttatttttagtctttttttttgttaatatagtttctttgtttttgtttatttatttttaataattgtagacaaaaataattattaggtttttaaattagtttgatgtttttaagcaatatagttgttggcggcggaggaatacatgtactgaagataaacacagttaaacctttttagtaaccgaaccgacccatttggattgagataaaatacaatcgaatagtttgagtcttagattgggtttggtttgggtcggtttgagttcggttgggttgggtcggttcggttaaaatgcccacccctactttcccatcatccccttgacaaattaataaccaaattagtcataatccaatctttcaacatgaaaaccggaatatgagggtcaaagcggacccattaagagaaaaggtgggtcagttgacacaccttaaatctacaaataaagtttaatgcatgaaatttgttaaagagataatagctaagttggtttatcatgtgtcattgacacccccattatccaagttcaatccttccctatgtactttttcgtaaaaaatttctttttatatattaaacgaaaaaactattgactcaggtaaaaatctttcctgggtccgccggtcaacgaggaggaaacacgacggaatgagagagagaagttggtggcctaatttttgtaggagaaaaaacacacagaaagaaaagtaaaatgttgacaaaatggggttgggaaattgagaataaaaattcaaagaaggcatgcatattgcaataataatgtgcgatttgtcaaacaagtggggctgtgagagagagcgcgtggtcagcacgaagaagaagcaggtacagagttttatcaccagctatctatctttggtttgttcttaaataataatcaaacgccatctctctctattctctatctatcttctccacgttactaccacctaacctctcatccaccttttctcctttaagcatatttcatttcatctccgaaaggaattgtatcgttcctcacacacgcctctcatctcttatccgtaagttttgtttctcttttctctattgatgtacccttttgcccatatttgtgcttgtgaactcgcatttgatcgtttatgctagatctggtttgggtttagtcgtttagatgctcgtcaagctccctttgaatcactagtgctcttagactcttatatttactgatttggaattttgtaattcaaaagtccgagtcttttgatgaacccccgtgccgaccacacgattgctttcaatttgggcttcttcttaattttggtgaactattgaggatttttgcaagtttctgtgtgaatcctagagtagaatgactcaaaaatgatttcttttgattcaattatatgcgattgttaatgtctttgaggttctatgatctggaattagattttggtattatcttagtatatcaaagcttagatgatgtttctttagcatgtaactactattgtccatataaattgcataactcatttaactttcgagcattctctgcgtctcgattacttatatggttcctttgtttgtttttgttcagattcttgtccttttttcagctcaacaaga

SEQ ID NO: 4935 - DNA, 666 bp, Arabidopsis thaliana
tttggtgtgttgttgattcttgaatcttaaatctcaccggtgaagatttgatgttgtttgttggtttaggcaataatgttattttggctttcatacagttttggtaacgttgagagtagtgtctctttgatgtttcaactttatggtttctattacttgagtgcttctttcttctctgaatatttatttcctgaatattagtgaccacaaattggtttataacccaattgaacgaaccgatgtaactatcgtagagaatctgttaattaagccaatccaatttttcaaaattggtttggtttggttcagattaggttcggtttgctctaagagatgcagttgtttgtgaaacgccaccgttttggaaaactgtgtagctcgaaaagatacgaacttaatgagtggagagaaaacacgtgtcctcagcttgaacagataattctgcgactcttgagaaaggaagacgaaggaaggagaatagtagaagaagaagaaagggagagtcttgtgatatctacgtagaaggaagatggccttatctcaagtgtctgcgtctctcgccttttctcttcccagtactctttctttctctcttcgctacccttcttcttcctctagttgtacaattgtctctataatgtatgtatctgactagtttcggatttc

SEQ ID NO: 4936 - DNA, 2000 bp, Arabidopsis thaliana
gttgctaaaaatgatttatttaaatataaattaaatgtgacaaatattaggttagtttttatgaatgaaaaaactcatttttacatatttgtactttttagtattttagtgagtttaacatcaagacaatcaatttaactatttttttaacgacgcatcttggcgggttctaccaacttaaataatattgttcgttgttctttattccatgcaagttaaattttcaagcaacgataaattatgatatttagttttgtcgtttatgaatatttattttttagtgtcggcgattaaactctcgttttaactaaaattaaaaattgttagttaatttaacatcaataacatcagattaatttgtccatcttcttggccaattcttccatcttaaatgaacattaactagtttgatatttcaatgataatcgcaagaataataatagaaaggtatttaaaaataatttcttagtatttggggagtaaaacataaatactattttttttttgtcaacacattaatactagtattaaatttgccaaattttatgacacatattggagtgttcttccattttaaatgattttttgttctctcacgtaaattgtttattaaagaaaccacaaaatatgatatcgattcttcattttctggttttaactattgcaccctcatttttaagtaaaagaaattgctaatataacttttttttttggtaatagtttagtttataaagaaaatctaccctttcaattatctatcaatgttgctttttaatcaatttttggaaggtgtatctctgcaaaatataaataaactttgtttttctagtaaatttagagaaaacaatgactaaaaaggtccaacttttacacgaaagtgatagacatccggaccactcttaactcttaatataaatttgaaaaatctgactttcatattattttttatctaaacgaaaaaaccaaaatgttagtcgtaatccatgttgcaatgaacggaccccataaataattatcctcccaaaaatctactcataaacgagtcatgacaatgattttttaattaatattcagatattgtttcctcagatctctaatttttccccagatacttccatccgaaaaaaattgataaaataaaaaagctagattttattaatttattttaactagtcaattttttttcttttatgagtttctaactttctatataaagtttcgaaaacattaccaataatcgtcgtaaatcactccccacctcattcatatttttagccgccagaagaactgattggtgtaaaatccaattttcttgctgttgtgagttttcacttctccgaggtaaaaaaactaatcccggcggtgagaatctcttgggaacttgctctgaacgaaactttttgttgcaataattgtaaccaaaaaataaagaagacaaaatctttttgtccttattgtagattccatcgccggagcctgtccgaaaataaaatttaactaaacttggcaaaattcattcaaaacgagtccaaatcaaatcaacccctatttcaacgcctctttttctccctgatttatatatcggagagatttcaaggcaaagctttctcatttcctcgtaattgccggcgaattctactaaaggtgagacctttttcattttcccagaaagtgaagcaatctttttggggttttattctctttagctttcttaactgatcaaactaaaaaagcaattctgttttttctttcttccctcctataggttagttactctgcatttttgattactgtttgatgatttttatgtttagggtttttaattgagcaaattcttctgggtttatcagattttatatttttgtgaattggttaagatttagatctggatttagatttttctttgtttcatggttgactgaaagtttgaaacttcaaatggagaatcactgaatctgactgatttgaattttggtggtgtttctagagtttgttgagca

SEQ ID NO: 4937 - DNA, 1223 bp, Arabidopsis thaliana
ctctttttctgaaacaatcccaatacatgattaatcaaaacccatgtgtggtggaaaaactacacaaacatacactcaaaatccagactcacatctactcaattatgcaacttcatcatgaaaacatcaaaaacagtcaaagtaacaaaatcaagtcagattcagcacacaaagccagtaaagatagaaaatttaacgaacgctcatgctaagctgcgcaaaatacttcctaatcaaaacagtaacaacgagtaattagcaaaatccgagcagaaaactctcacccacctccgaaattcacgtcttcactaaaattttcgaaaggaatcgatcaataccaacccattacacaaaatacataatcaaaatggcgagaatcgtacctggaaactttgcttcaagtcgcagagagaggaaaaggaagatcgtggagaaaggggtttagggtttaagctcagacttctattggagtaaatgggacggtgtcacattttccgttttggaaatgaactttgggctcacgttatgggctattagatatttgatgggctttctagtaaatacaatataagttattgggcttagtttaaataagcccatgttggaaatatttgacacatgtcttggctactagtgctaaacatgcaaccgaacagttgtcgagacaagtcgcagcatatacaatggatcaaacacgcctagtgtcgccgcgtctcgctcatgtgtcaccttgtttcctcgtttttttttaatttttcataagttcttttgttttatcttcaatacaaatttttggctgtatcttgcaaactcttcgatcatatcgccaatatacgtgaacactggtgatctaatttgttgtgttaattgttaaatttagattctattctccggtttaaaagtgaattatatgtatcatggttaaaacattgtaagtaagatgataataaaatgataaatttagttgatggataacgtgaagcaaaaaatgagatagatacatttgattttgtcgtattttgacatatgcggagagtgagctacgcgcatgaagatcaagagacacttgctcgagctcacagagtgacgtgtaaaaagcttagactgaagtccccatgcaaacctaatcctacgtggctcaaaccacgagctcacttgacaatatataaactcctcctaagtcccgttctcttcatccatctctcacaacaaacaaaaagaaa

SEQ ID NO: 4938 - DNA, 2000 bp, Arabidopsis thaliana
tggtttacaatttcatgtgaattccatagtgatcagtagatatatatattgatcagacaaagtagatacacattgataaaacacgacaaaatgatgtgatatataagacaaagtgacccaaaattcgattgaaaaatttggggtacgttgatttgaaaactcatgagagttttttgggatagaaacaaaaggagagaaaagggttaaagaggaggatgtagacaaggcaaggaacaaaagtagggtttaagatgttttcgcccctgaattttatttgatgtaacttgtccctttatcatctccatgtttttcttcttctcattaatttaaattttggctttggaatttatggtgatgttaattgtaccctctcttcctttggattttgatgccactcatgtcccctctcatagattttattagggtaggaatatgcctttttccctctttattttcatatttattgaatttacgttggttaattatggttagtacgcttggtgttatttaaacgtcccgtattcacagtttacgcctaactgattactttgaactaaaaccagtgtctagtagatcactaaagtcgaattttgaacgaaagtttgaaaattcgcaaaagcgccgtgaaaatacaattccaaaacatatcatttttgtttttggaagcgtgattgatgaaataaaaacaaaatatgttttggaagtgcgacagaatttgtttttttgtttagaaatgcgataatatagacaaattaatagaaaatgtaatacaaatttaggtgctttcataactacaaaaaaaaaaaaaaactaccctattgttgaaaactttcatactacaagaataacacaagcaatataaaagaagaaaaataattttcaataatcaaaaacagacattatattttagtagtcaatttaatctgtaaatatctgtaaagaaaattaatcaccaattttattgttaactacaaagtggtgtttataatattgcaatttatagtttgttaactacaaagtataaacattaaagagtaatgatgcgtttttatgtgtctagatacacatttcgctgtacgtgtttataggtgagtttttaatcaataaatattgaagatgtaccgtatgctttattttgtattggcatgagaataattatatacaagagggctgcgcttttattgtgggatgaataattgaatcatgtggatgtgatatgcataattggaaggttccggcgaagaatcttacggggaaaaataatcaaaatcatgaatatatattcattagttaataattatatttagaagtcaaaaagcataatatagttatattaataataatgtacatctctattgtaacactctcatatgagatgtctgcgacctcgccactcaaaagaatatatatttataaactatacgttgatatagtttttaagaccatatggtatatacatatatttagttagataccccatatcaattaatcggttcatcaccacttaattcacttggttgcttcgaatgtgtttcataattcacttgtaattttaaaatctttccttcacttgtgctttcgcttgtaatctcaaaatgttatatatctcttttaacgggagaaaaacgattaaagacggattaaaatatatatccattttgtatagtcaaatgcaataatatatacataatctacaagataaatcataagaaagattcaataacagtaatagagtaataacagtgattactgattagtctaaaagactaaaactcgaggatgatgacttaatcaaagggcttagattcatccacgtgtctaaaacccgtttaatcaaagatctcttaaatacgacatacacatgcagctacctcctagacagagatataatacagactcatctcactttgtattatttgagtgtttttataaaaccatttttccatcttcctcatcaccttcccaagaagaagaacaccaaagaagaagaaaggttaata

SEQ ID NO: 4939 - DNA, 2000 bp, Arabidopsis thaliana
agtagggaattcatagatcattgagatagtaaagtataaaatggttctctgagacaaatttttggccttggttataaagaacaaactgtttagtattgctgagatgtggcatgtagttgttataggctctctgattctgaatgtaatttatctattcagtttgagaagtctctccttcttggatttagaagtatttttctttagtaatatagtgggatggcctcagttgagataataaaagcgtgtccaaacgaaactgatagttttgattccaaatggagattattttctagaacctaaaaaccccaaaacaaaaaaaaaatccggaaataaagttgtttagtaatttttcttcagtgacttccactccttagataatcaatatcgtaattgttgtcattgttactagaaaacacataaaataatttccaaaatttatatgttaagtaatatgttggaaaccctaaaatctgatgtttgcttgagctcatatcgcaacttgtacgtttacgtgaagtctaatccacatctgactactgctaaagttagtttatcctatttagtttcttctgtagtggggatataattttcataatcgtgaccgcttcataacaatgtcgaatgggccaaatccgcgaacacttcacctagttaaaagttaaaaacctaataaaggtgagttacattacctaaatcttgatttgaactaagcaattttcatgctatgcgggttagatttctaaaattattagatcatttattagcaaatatcttttgtatcagattactttgccatataactaggtgtttaagaatagaggaaggatgtgaacacatgttgaaaatgatgtctaaacgatcgaatccaaattaacacttataaatcgatccggaaaatcatgaaaatgaaaagaaatgtatagtgttagttaaactgtaattaacttaaacatgacaaaatattttatataagtgaagttactaaatgattcgtcttaatagaaacatagccttagctatatatttttttccttaggttggatgtttccacaactccgcatttcatattttgtttctaaggttatgtggtggtagtccgatgttttaggtcaagttttggtcgatggttcttctttctatctttgacattttcttttcttggctttcaatcagtctttcatatctactacagcggtaaaaacagttgggcgtctttaagtttattctactctagttcaaaatcataagtgattgagatcttattagttattgttttttcggtttatatctcgacgttaccgatgttggcgaatagcacaaggttccctaaccttaacctcaaaagaaagatccactaaatagaagtaaataaagcatatgattcaatttcagaagtttacaaaacactaaacaagaacatgaaaaccaaaaaatagtgaattgtcttcttttttgggaatagtatctctggagatttcaacatttatgaccaacttatttttttggaatactttttttttatcgttgactttatgtaatttctaaattttactatgacaattttttttttttttttttttttgtcgtttttactatgacaatttaaatttagtttataaggacttgtgatattaaactattaataacaatatgatttaaattttaaatataatttatatttccacatattgttcttagtgtatattctctgtattttccatttcgagtctgtggagtggtctctcccctctctaccctaaaacacactcacccactttcctctgtataagcctctctctcctctctcttctcctctgccatgaaaatcgcagttcctcaagacaaaacctcctcagaaatctcccatctttgatgacttttgcttccttagttttcactttcttgtccgaacgctctcaaaaactttgagaccaccccaataaacgaattaaacagactattatcaatcaatacacaacacaacaatcaaaccaaacccc

SEQ ID NO: 4940 - DNA, 317 bp, Arabidopsis thaliana
tggaggagtgtcttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaaggaggaat

SEQ ID NO: 4941 - DNA, 675 bp, Arabidopsis thaliana
gagatcttttgatgttgtttgtttgtttttggttatcactttactcaaactttgtgtttctgttacaatcaattattttgtttcctgcaatctctttttatcaacacaacataaaaaatactttgagatcagaaagccatttgcaggtttggttaatgacttatgagagattcaatatataataattacaggttgattcttgcatgatttgaagctgaaattcacttaaaaaattatagaatgataatcttaacccttacaaacaaatttgagattatatctaatcaaggcaataaaaaaataagcaaggtgcagtaggagggattagaagtttcaaatccgatttttatacatgaaaaatgacgaaatctaataatcttggtgacattttctcacagagaaatcggacaactaaaatgagtaaaaaaaattaaaagaacgaataaaaaatcaactgagatatatataaaaaaaaaactggaagaagaagaaggaccgcgagctttggatcgaatttgttaaatttttcttctctcgataataaaaacaacaaatgatcgttgatcgtttttctctagattcgattccgattccaaagaactagtctccggcgtgtaatctctgatcgttgaagatccaagctacgccgcatcttactcgccggcggcttgaatc

SEQ ID NO: 4942 - DNA, 2000 bp, Arabidopsis thaliana
gtaattcaaacaatttgaattgagtaggttgttgcttgaagtaggcgttcctcattatacgaatcttttgcgtttctctttgttttcatgccacgtgttgtctctaccgctcacacgccacaagaacattcttgaaaaggcttatcaaacaactttaagaacatatttctattctacccaacagtaagaaaaataaaatatatcagttatttggtttgacatagctagcgtccaactaattagaaatgatcagtttatttacattatcatccaagaaaatgcattgattcataatgattaatacaaattttcattggttattcatgggtacttttcttaccattaatgctaaaaaataaaataaaattcaccaatgtacaataagtttcttaattagcacacttttttgcgtttggtcatctgttttatgtttggttttataagtatagcattacaattattattttagctttaaaaacttaaaatgtaaattttaaacacgtgaatgtgcaagttattatgcatgtggttaataataaagggtacatgtgcgtatgagctgtgaatgtgcgtatatggcagtggacagccgtaaatgtctgaccaaaatcgttttccttatctttttacccaacagtactactactgccttaggttaaaactcatcttgtcggacgcttcttcttacaagtttacgtcttttatattctaaaattgtaacaatatattaagtttgagaaatctttcttattaattattactacgtcatttttatgtgttaactatttttgtcgaagacttttttattcttgatcaattagtccgaaaatcactactaattcgtaaacaaatttttattattaaatacctctctgtttttcctcatttgagaacgtgatataaaatcaacataatcgaatcttcacagttcacactagtttatcattataataagtgaggggattacattttaggtatttagagaaaacggggaaaagataccaaaatatcttagagacccgtggttctatatgtacattttaatttttaatttgctaaagtcagccatgaatactatagtatacctagtcagatttgatgatgatggttgttaaacccaccgctcctcctagtcaaacatcttctacaatttccaaacacattcaaaaaacgcagaaaaaaaaaaaaaaaatgtgtatatgtgttacaattcttaaaagaaaatgtaaagccagataattgttacaagagatgtacaaagctccaagtgtgaagaacatcaacatgaatatgatccatgaaatctaccaaatttccgtgcttgcactttcccatacatttttgtttttcacctaactcttacgaacctaaaataaaataaaatacaaaaaaagggagaaagatttgagcacttgtcgacacatcgtagcatcctacctctgccgacacgtggctcgagacaaatacggaactcccggtcggaacagaaacaaatacttattttgactacctgaaattcgacacgtcatcaccttctagactcaaaagagtacaaaggccaatgagactctaccattcctaacgaagtgtcacgtcacttcctatcaaacctttccttaaatacgttcactgccgcgtcactcctcttttttggtcacgtttcctatttttgtactaatacttcttcttctctctacacatattttgttggtaatcacatcgaagattcgaaattggatcacatttggtaatcaacttttttttccaaagtctccacgtgtatggacgattacatacgtacacttatttattttcgctttggtggataaactcgatgttaccaaaagtatacactatctaattaccgaaccaaaattaatctgaaacccttctatatatatatactttctttgcaataacagagtgaaagcaaacattcaaaaaaaaaaaaaaaccattttttttttcttactcaaatcttttttagtatcattctccaa

SEQ ID NO: 4943 - DNA, 2000 bp, Arabidopsis thaliana
ggataaaatggtaattaaaaatttagagagggtagaaatgaaaattgttttaaaaaagggtagagttgaaaagggtcatcataaaaaaggcattaaaaaggatttattattatggggagacctacaaaactaccatttttttactaactttttgcaacaatactcttttctgttctccatttttaaaaataccatttcccttgaacagagtgaacaaattaccctcatctaataagaacatgtaattgaaaattaaaatcttttcccgccaaaaagaaaatttctgccaaactttcttttccgccaaaaaaatgttcccgccaaaatattttctcgtaacaaattttttctcagccaaaaaaatgcttgtaaaaatccttgtacattttttaaaaactctttaaaaaaaccttgtaaaattttttaaaagctttgatagttgttaaaaactcttgtaaatcatattaaaacattttaaaatctttataaagtctttaaaacatatgtaaataattttaatcccctttttaaacctttgtaaatcattttataactttttacaatagttttacaagatttaccagagttttttaagagttttaagaagatttacaaggattttaaaacctttgtaaatccttttaaaactcttataaagtcattacaaacattttttaactcttagaaaaaattgtaagtatttacaacatccagaactctttttgaaccatttttaaactcttgtgattctttacaaaatgttttaaaatattttacaagagtttttaaaggattttaaaactcttgtaaatcttttaaaaactattgtaaatcctttaaattccttgtaaaccatttaaaaatcttttaaaaactcttgtaaaccctttaataatttttgaaccattttaaactcttgtgaacctttacaaaaagttttaaaaagatttacatgagtttctaaagggtattcttgtaaatcctttaaaatcttttaaaaacccttgtacatctttaaaacctttttaaaccctttaaaaatctcttgtaaatcttttcaaaacccttttaaaattccttttaaatcttttaatacactttaaaaccctttaaaaatctttaaaaatttaatacactttaaatacattttaaatctatttcccgacaatttttttttttgcgggaaacatgtttttgaaaaaatattttggcaggaaaaatttggcaggaaatttattttgaaatattttatgcgaagaaatattaatatttcattttgttaacctaaaacaatttccaaatagtggtaaaatggtcattaaaaatctaaaaagggtataaatgaaaatgacaaatagaaaatggtagaactgaaaagaggtagtgtggaaaggacattctcagcacttattcaaaatttagttgtatgattcacagtacatctttaaattactttagataacaaactttctgaaatttacgttagataacaaactttatgaaattactaagagtaatttctagcttaccacaattctatatacattgacaatatattactgtattttaaaagtacaatcacttaaaactattacaaaacttcacattataagaacaaagtaagctagaaattactctgagtaaaaagaaacaatgagagtaagataaattaattcttagtaaaagcaaaacttataaatataaaatattatattacatgccccctgtttttatatggatatattttttttctttttttttgtcatcggatattatttaggatcagacgagccaaactttggataagaaaaaaatatttttatatagataataatgaattacctggtcaattaattaataagagatttcctggatgttatttagaattaatgagtccactaaattgataagaatcgtagtgactagaatcaccttctttgctatataaacagtctttgagccaacaaattaaacaaccacacaaaacaaaaaacaaattc

SEQ ID NO: 4944 - DNA, 2000 bp, Arabidopsis thaliana
ccaaaatcacgattcattttattttggataaataaaacctcgattcattttatgggctatcggatagcttttcactttcagtgatcagaacttcgcccataatagcataaataccatcgtaccaatctacactaagccttttttttttgtttaatttgattacaaatctacactaaggtgtcaacagaaacctattgcagtactgttatagttagaaactagaaaacactggaacatgattttcaaattaggtcatcaattcaaataaagatcttcaaaaatagcatttactattaatattacatattataccaaagatgcaccagttaaactggtataacactatatagaaagaacctagaacatggcacaccacacaatatttaaagctgagacaaaattttcaaattagaatggctaggctatcttaactagctagttcgtcaggaggttgcgataaatgattgatataatattgttatgcttgcagttgccaattaccatatgtgtgcacacataggtaatgtagacatgcgtcaggcgttgtccacattaaaaaactatgacttactcaataaggttttggatgcctaatctcttgtcatataagtttcgcaaaaccgactcgactaagcagataagttacaactagcattttgaattaagggtttaaagtccaaaagattcttgttacaaagagttgactagaaccttatatttattttagataacttgactcgaaccttgcatgtgcgtgtcgaagagttttccggcatagtgttaggctttcaattaagttctaggcttttaattaagtttggcaagtgaagtagctaagctagctagccttgtaggtaaccatttaatatagatttacgttttgattttaattggaccgactatgaaatagaccaatataaaacatcagtctacatgcctagatccttgagtatatattaatactatttcacatgtacaaaccatttacaagttggcatcaattttgcatgacttttttgtttcgataatattttcgctttttaactacttcatcaatcatgtaattcaagctttgactaccatagtagaaaatttgtcgtttccacttttaaaaattgcttttagttacctaatgcaaattttttgtcaactatataaaaggctaaaacgcaatcaagaatactgatttcacaaaaaggcagattttagatgcttctaactaggcatagacattagacatcacacggtgtttgttacctctacattgtagtaatcacttgaaaactcttctttaaaagcgacgggcaccggtaaaatatttggattttttgtgtgtgattaattctacataaattcacagaatttgaacatttgtttactcaaaaatagtagtatgaaataagcattaatggaggcaactatgggaaactcacacgaaagtcctcgacccatgcatatgttagatgaacaaacaccctttacctaattggctaattcacaagtcaataaaacccatttcgccacgtgtcatatgttcccaccgatatttttaatttctcgttaccccaagaaaaagaagaagaaaaacgtatttggtaatttctactttaagaaactttagatatgataggtggactcttcaccttccccaaataaataaacaataaatcaaaaccgcatttacatccaaacagtcaaaatatcaacctaacatacttttcccatgcaactcacccagactttcttatttaacatagccttcgtgtcttcacacatccaaacacgtctcttcatgcactctctcgcttctatataagttttcagtaacataacagatttatacatatccaacaaaagtcccataaactaaacaataaacactgctgtctcttcttcttcttcttcttcttcttcttcttcttctagaacagtacgttatgagagtgttttaaggccgttaatttgttaaatcactctttaaaagtttttctattgtatct

SEQ ID NO: 4945 - DNA, 2000 bp, Arabidopsis thaliana
tagcagagatgtccgatccgccgtccgtcaatgcttttcacagcgtttgtcagcttgcttctggcatccgtcggcttcttaagcgacggttggctggctttggggttttgtttttattttcgttttctctcgattcattttgctttagtttgtttggatttagtttgcgttttaatcctttgatttgactgcataattctctgatccttctttgtttaaagagcttaattcgattttcaagctaattttctcaattttaaaaatcggatttgaagttgcggattggagttgtcgttggattgattttaacgtaattgaggctaatttcttcttaccaaagcatgtgaatcgttttatctttcctgttttttaggtttaataatggaagccttgtcagcttatcttttaagtcgatgatcccggaattcatgaactgcgtttatccatggaagatttcaattttgcagatctaacggcgaagtttgtttgggattctctgaatttggtggtgatgttcatcggatattgttgagccttgatgtattgatgctcgttacgactttttccggtgactaagaattcctttcggttgcaaactatgtcggctgaccgacgatgacctaaaactccgacgtctcacgtgttatcatcattgtctcctttcgtgacacgtgtatctgtgctggacatgatcgactcttccttcaaccagtggtttcatgaattgttgggcttatgtttgtaatgggcttctttttgccgtctctgataccgggtttgaataaccggtttgagcgtttgtctctttgtacttgaagtattgtaagatgttatgcttttaataaaaaaaacttttatgtgaaaaaaaaaaaagaataaaataaaccagttacctcagattccttggatacttcaaaaatgtcggtttgcctatgaatcatagactttaaaagcttttaaattaaataaagtccttaaagtgggattagtaaatttttggcttttaatttttgttccaatcaacccctaagacactcaagaaaagaagaagaagcataaaaagaggcctaaatgcccagagaattaaacaaatgggccttaatatataaacaaacatcaatctctcgccgtcaaaggttacatctatcgccgtcaaaggttccatctatcgccgccgctgagaccgccactttaggccgtctcgtccgcaatctccgtaaccaacaccacccgcatcgcctggtaagctcgattttttaatcatttcgatctcatatgatgtcgatctgttcaatcttgcgaattcgatctttattttgttctgagatttagggtttcacgaatttgtgttctaggttttctggcttaatcatttttattgttaactgttctgattggttcttatgcttttggttacacaaagatctcgactttttgttgactctgtatgcaaatttgtcaaaagtcaaaacgttgttacagaaactctctttcgtgcttgtgtttatgtatgaacaatagcttcgctattgggtttgttgatttcaccacacttgattaaatatgtatattctattgaaaatgtggtcaatcttggcaataaaaattgaattgttggtttagaatgtggtcgtcactcgtgagtatagattggattagtggatcgaattattaagtcagtggattgaattgtggtattattaaattgctagattttggagttggtttcattattaaaccaaagtctaatgaatgtaaagttgaatttatggaaaagtattggttatttccggttaagaatggattacttgaattataagttacttcatgacctgccttgctattaaagtaaaaactggttgttacacgaacacagtagaacaatgtattaaaaacagcccttccctctctctgtctctatatatctgtctatatcatagttttatgaattgatttttgtgggggatgattttgcagcgaattgatcggtgaggtggaag

SEQ ID NO: 4946 - DNA, 1644 bp, Arabidopsis thaliana
ttgagattcaaagctggattctttgtacaaagctaattgttttgtatttggatttgattcagttagtcatagatatagcctaagctttttagtcttcttttcttttaaatctgagattgtgaccatttttctctttttaatttctgcttattgttggttttgtacatttttgtgttgtgaggaatgaagtttgtttatttataagaatgtgggaagataatatttggtcaaatttcaatctctcttcaatctttgtaattctagcattgagcacatagatgtgattctttgtcatatttttatttattttaacactagttcgactgagaaccaatttatcatcgacaccaatttctaagtaagaatatttttaataattatcattattagtcgtatatttttaccagaataataaaaaattaaaaacctaagttaataaaccacacaaaaaagtttttctctcttcgctctctcgtagtttgtaaagatagaaactgaaatttcttttgtttttgttaaccggatagttttccggtgagtcgccgtcccgtttaattcgggctttcgtccgacatcttctagctacgttagtggagatggttggctttttgtatggcatcgttggctaacttagcgacgttggccagcttccgtacggcagcgttgggcttacactaacagcgttggtcatctttgtttttgttttgttacttcaaaggtttgatgatgaagctttatggcatgcagaatcgtcagatctgaagagggtttctctttacaagatctattctccttctgttttgtttagcttcactattgggttatgcttttggctctggtagtttttcggcgatgtgtgcgtttccagcaattaccctcgtttggatctaccatatttaagacagtttcaattttattttcgcctaagattgggttaaagcttctatcctatgcaaatttgatatgcctttagtgcttttgcaagagagttcgaagattcaatggttggacaagtttgaactactcaatttttttaatttctttacccgttttgatgaattatttgtgattctagcaaccatatgagattaggaaattgatgtttgttctataacatctaattgccataatcggtgatagaaaaaaagagtttcattgctcggtgctttcccggcgatggttctccgattcaccagacttgagtctcatccggtggaggttgtggaagattcacgtgtccttagcttattattattggtctgacacgtcttaagcttatctcttttttgtgacgtaaaagtctgttgtggacctcatatgtagactgtcttgagccttttatgttgtaacactgagcctcagtatattaaaaataaatctttctctgaaaaaaaaaaaaaaaaagttaaaaacctacgctaaaaaattctaggtcttggaaaagagtatttgggccaaatgatcacattaattagttatgggctgaaataacattctgaagttttatgaggaccgagagaactaagtttaagaaaaatgttgaaaaaagcgtattagcagagggacaaacgctttttagggttttagatttcctctgagagagaattttcgaaagcttgagagagatttccaactacgttagcc

SEQ ID NO: 4947 - DNA, 2000 bp, Arabidopsis thaliana
cagaatctattatgcttgaagcttcgcctttatggaaattgattcgaattatagttaacatgaatcatgtgtattcgtttacacatgacattgaatttctggggttatgacataagaaggttcgagtggtaataaacgtatatggttattttcattttcttaatgcattactcatatatatatatatatattaaaaatctagtcagtattcatatatatatatatatatatatatattaaaaatctagtcagtattcattatatataatgttttgtgataaaagtatatgttttaactgattttcaagtagaagctccactaataagtacttgagagatgaccgtttgttgaaagcttttgcatggtttttataataaaattatatatttgataaaaacatatttgtttaactgttatcacttaaacaatgaaaagtgtttgtataattacatttgatttctaatatagttgggttttagactggttgaaagttcattccttttgcattgcaacgggttatactactcccaagtaaaatgctgggcctgggctgaatgaccgaatgctatcttatatgtactacaattattattttttctaaaaatttaaaactagaatatcatttatcaaaaaagtaaaaaaatatgaaaacctatacaaagccaaaaccaaaaaaagaaacacacacacacacctacacgtttctttatattcgttcgtacatttgactagtcggaaaactacacgttcagtatgctgacttttctaataaattaaatcaagtggacggtaatattcaatacgtgcgtgtctcactgttttttttttttttttttttggctccactagtttgattaatacgtacgtacctaaagttaggcagactgagttgtttggtaaatcaactaataatatcttaacatacaataaacctaatatatttataacttgtagtatcatatttttgtgaagattctacggtagaggtttggaccgtgtggtgcaattcttcctagttactttgtgtgaaaaggaaaactacgaatagtgatggtaactgcacaaaacattaagcagcctgcataaagtatatttatttgtcgtaacgattacaattgtaattttgtaacagaaagaaacattataattggcgcaaaatttattaaaccaaaaaaaaaaaaaaaatggtgcaaaactttaaaaaagtaaagtatttctaatttgatgatatataagatatagtactctccagatctctccatttattgtcaattaagtaaaattttaagttgaaaacttatcttccgtaaataaacaaatgtgattggtacgaattaataaagcaagccaaaaaaatacatgcacaacttttaattgttaccaagtgacagtacgtacagtagttatgtggtcaactggtcattgctatgttgatgggggacatattacttttgatttctgctgaacacatttctgtggttattagaatgtttacatagcaatcatatataatctgtggacttaaaacttttatcaaatttatttatttatttaaattcatcggcttagttttggtttgattgaggtctctcatataccacaatcatatatatatatatatatatatattcaataatatagtattggatatatcataaaattaattaaagagattggctcaatacaaagttctctgaacattctttgtttgcataagtataaaaagatgtgataagttttggtatatagatttttattttttttagacaaaaatatttctcgttgaaatactaatgagagaagatgatcattaatcttatcttacaagcatctcatatctcagttcttttcctatcaaccagatataattaactaagtaacactaaaccgtccttttacgccacacaacctctacatacaccaaacgtatatatctatctactacacacacaaaaaaacaccaaatgcaatatacgtttgaaaagaggcccccccatta

SEQ ID NO: 4948 - DNA, 807 bp, Arabidopsis thaliana
ttgatatatgatcatttaatataaagattggcttcctataatgtaatgttttagtgaagcactatagaatatatggttttggatattgtatattgtatagtttctctgttcatggaactctacaacaagctcatttgattatgtgtaagcctatattgggtttgtatgagcgaagtaataagtcaaagtttctggtgatgaaaaatcgaattcgaaaccactgattgttgaaaatagctacctgcttttgtaatttaaggcgaaaattgtggtttggtttgcagtagttgacgtgattcttgtgacctgctgcaattttgtgtaatgaaatgtgataatgttgacatttggacccaatttggtcgcagatgagaagggaatgttgttgcctgagccgggaaaggccagacggtggtcacgagttggaggagccaccgtagttgcgacggtggtcttacatgtcttctagaatcttaagattgctttttgtattgttttgttttgaatggttgagtgatgatatctcttcataagatgaacagagtctcactcttttagatctttccaatctgaagttgcgagagtttttaaaggttcgagatttgcattagaaacagagcatacaatgaattgttagtcagtgggtgttggctttgatatattatatagcaaaaagatatatagagatattgggagttaaaatgattactagaaaataaaaataaaaataaacatatcttatcttctctgtttagtggtggttataaagtacagaacagagaagaagcaacgaatctcattacaacg

SEQ ID NO: 4949 - DNA, 558 bp, Arabidopsis thaliana
tttctctatgtctccttgtgtcgttctaggtcgcaggtggtctgatttgtcgtcggagagacggatcctttctcggtgttagcttaaacttcggttcctctgcttttgtctttttttttttcagagagaaaaaagattaatttatataattaaccaattaaaggtggaaaagaaaagctaaaccgaattgaaccgaagtatctaaattaaaatttaaaccgaatttttatcatttttaaaactcaaccaagaagaagatgaaaaggcaccgtcatgctgacataagttccagtcccaatcaacaaaaccggacatacgtttttgatcaagctagagcagaatcaattgatcaagaaccaaactaaaccagcagcaaaacaggacgtacgtttttcaaccatacaattctcaaattgtcgtttctatcttgtcttctctcaccacaagaatgcaaaaacataaatccatttttcttgataaccttcttcttcttctttttgtatatgtatgaagcagctttttgtgaatgaatcttcgaaataggttaaagaaacaaaa

SEQ ID NO: 4950 - DNA, 910 bp, Arabidopsis thaliana
tgaaagcttccttctttatctttgcaaatttcaaagattttgggaccgagtttttttttttttgttcaagttatcagagacttgtgatcttttatccgagataggctttttatgactaatcatgttattttccaatggcgggcttttaaattgatcttgaatttttattggctgttagattgttccttcgaagcccaccaatccattagaaatatctggttttgaccggttgattaaataattccggtcgagctgtatcaaagatagaatgctcttaaccggaatcgttgacttcaagagtacaagctgttctccatttttttaaagagattatatcggttgtgcgaaattgtccaaattttgtttttatagattgaccgatcaaatattgtagcggttaattcgttaaaataaaacgtttgatcagttacatttgattaattcaatatcaagtcaaaattttatcttgttaaaggaaaaagaaaaaatattgggtttagacctttgacaaaggaaaaaaatggggacttaaagagtctaattagacctcaattaacaactcttggtggctctataacattagtaatttctatttaggttgtacattgtaactatccaaaactctaaataaagaaaattacaaaacatagaggggacaaacacacactgacaccgcatacattacacattatataatgtgcatgaatacaacctacactttctagtaaagaaatgaaaatgaatataacctacaaattttaatatttaaagacacgttctaaagaataagatcgccggtttaaaacaattacctggtcatcattttggattaaactcattaggcattcattatataattgcaccaaacaagaaggggatcaagaaaatcacgaatcaccggagcaaaaaa

SEQ ID NO: 4951 - DNA, 2000 bp, Arabidopsis thaliana
tgaaaataaaatatttcagggtttttctatagaaaacaaagttgatttcgaacacaatgaagatcatagtgtgttataacaaaaaaattctttaaaacttcattacttacacgataatgcttatcttggctccaaacttcgtaaataaacaagatcaacacttcttgagcatcaatgtttgttcgcaattaatgtttgttcctgggttcatctttaactcaacaattattatcaataattttataatattataacatgtaataatgattttgtattaattataacaagagtcacgtctaaactttttgggcattaaatgttgatgtcatttcgtttttaatggaaaaaatatcccttataacctatgttgcatggaaacggaaacggaaacggaaacgcggatacgaaacgtttcggaaacaggaaacaattttttcttaaaattagggattggaaacgttttggaaacgtatacacatttatacatatatatatatataaataacattatatatatatatataacattatatatatatatataacattatatatatatatatataacattaacataaaactatattaaagaaaaaatggtttaaataatacaagtccaaaatatcaatattaaataaataaactaaaattctaaaagataaaaattaaaaggttcaagttcaaatagttaatttagaccaacattttcattagttttatcaaagataatataaacctcttttcaaatctggtttaacaaaaaaagatcttaaaactcaaagtcttccaaaattagttatatgtattaataattttaatattttcaattttagttattaaatttttaaagtcaataaaaaaaatttgtcgtatgtctatttcggaaacgtgagtttctattttggaaacgtaagtttccatcgtgttttcaaacctagatttttaggaaacgtgtttccgtgatgtttttcgtgtttccggagagtttccgtttccgaaacgtttcggaaacgagaaacgcacctcagagcgagtttccatgcaacctagcttataactgtacagtcgtactcctcaacgtgaaacaaaaataattccaattaaaccggaacagtatacctaactaaacctgactaactaaaccgtacattcaacagtttctctgctgtagcagcaagggcaaaatgatcaaatttcagctgaaaagacaaaacgtgaaaaccacctttcactttgtcagtccttaaaaataaaacatgatcaaagggtgtggcctgcaaattaccctaaaattaaaagcatacaagttctgtaaccaaggttggcacaatgtattctcttgtgttacttaaactatgatggagatctttccgtttgcctagtttttgagaatttggttcatcttctgtgttgcagccgaacttaactgggaacttaaacagcataaccagtctacattggtacttaaagattcaggttattgcttctggcaatgccaaaaacaacaggtttcatggtctacaataataaccaacatgaacatttgttggtaaaagatcaaataataattttattgaaaaaaatggtaaattatccacatagggaagtgtgccttattttgacgtaagcaaaatacatgtgagaaacaaaagtacattactttagtgaaatgaggcgtttttggtgaggtgttaaaaaaaaaatggaaaacatgattaacgcctatccaaaatatgttgtttatggaattttatagccgtagcatcacacaatagttttacatatttatgctcattttcataattcaaagattttattccttttcttctatagtagatttgtgagctaaaaaattgttttcaattgacttttcataattttattactatactagtagatttgtgacgtcattgttttaaagttgaatttttataaaatggtaattaatcggtttatttcgtatattcctgaagacattttttctgaagaaagaagaaaag

SEQ ID NO: 4952 - DNA, 1682 bp, Arabidopsis thaliana
ctgagctcaggaccaagcggaccaggtgccctctttgacagcttcagggaccaagatatcaatgtggaaccaaaaatctagcaaaaagtcaacgaaataaggaacttccatcagagaaataaaaagcaatggaatccaaaaaatgtagcatagttagttctatacttaaaacgattcatcaacgccaattaaaatcaaaacagagagatcatcttcctaacaataatctccgatataactgagacaaaagatcagaattttctcacaaatttcgatagaagtaataaaaaaaacgagtaccagagatctgagactttttccgagaatagcaaaattaaagacgcaaatcgataattcaaattccgagaaagcagaaagataaattcttcagagaacccgaatcgaatcataagtcataagagaaggaactcaccttgaagttgtagagatgatcagatgcaaaatttaccaagtcgttcgtagacgaacaaacgaagaggaagaagagtaaatctgctgttacccaacacacagtacaaaaacaatcatagtacgacacgtgtgaatctgtttaattgatttatgaaaaaagagaagaaattattgataacttgaaaattggtccaattagttttaaaatgtaacgaatagacccaatcaaaagaaaagacaaaataaagtatagagatgatgaattaacggctttggacaagccacacgattcgctttgcttatcttgctccacccaatccaaattgagacacaatctctatcgaatccacgcgcctctatcttttttcaatcgagtcgccattaacatatttcatcaagctcagtccactcttctcatgaaacttcatcatcatcgaccttgaccctgataggttattaaagttactgcatttgatctctctttgaactgcttctgttgttcaaggttccaaacatgctcagactcagtaattgaataatgggtattcttgttgcaggtttcagacgacacccattattgtaaatctgctgctggagtcttttttgtctgaatcttcttcttgttgagacactgtttcttcttggtctgtgatttttgttttgttctcattaggacgttctttattccggttcagatttactggatcgtcattttctctttgaaattgtatttttttgttccttttctggtatgttgtgaaagctatgagattgctgtaagaatccaagactgaccaacatgtttcccctgtgctcggccacaagctgccgttaccattctcaggttagattttctttatagaagtgaaagtaaataagctaactggtagcaaatttattgaagtcatccaatttgagctatgggtgttacgctttgttagtgctttgggtttttggattcattttcatagataagtaagtacctcataacgggtttgtttctgcagattttatttcctggcaattggcgaggctgttcttccttcaggagagagttgattcacagatacagttcaggtgacaatgccttctttggtatctctaatggaacacgcctgcagaagagtttcgtacctcaagccactgggagtttcttgaccggtactatcgaaaaaacagaacaaccagtatcaacattcggaagtttgtgccagaatgagttggacagaataaactacatggtttataac

SEQ ID NO: 4953 - DNA, 1227 bp, Arabidopsis thaliana
ggttccttatgtatatgatgatgctacaaggattatgaattgatttgttccaaacatgatagaacatgtaattaggccttaatgaaaaatcactgtagccagattaaatttccaatttcccaagcacttcacattacacagaaagtttaaaatcttaattaagctcagagagactcaggagaataaaaaaactggaagtcccaataaaggaaacagacatagaatcattatagaagttgcattaccacctctaccatatgaagatgaaacaagaaaagtaaaaactgccagcaagaacaacaatctcttttgtcccatgttctgcaagaagacaataaacacaaccacatcatcctctgttcatcaaccaatgttaagggcaaaattgagctaaaacaaagcagaattcggaagcaaattagccaaaaatataccttataaaacgagactcacgaaacccaaactaatgaggattaggacaaaacccgaaagagatttcagcaaccaaaagtcccagataaattaaactgaggatccaaagcctaaattggacttcttttacaacaattcggaaatttccgacgatgatcggagattattcccggcaagaaaattatacggcgagcttatatattattatatagaagtcgtgatcttgcgaaacagaagctaatagaagaaaagaaacggcgattaaaatacgaatattcggttttttttttcttaacttccactttcatcctctatacgcaaaggtgcatgagacaagcgtgtaggctctttcaaagggtattattggaattttaggtgtgtagcgtgtcgcaacttcaagtgctgaggtgtcagatacgtgattcgggcggataaatggataaggccgttccgttataagaacgagaagttgacctttttgactttcgctttcttctaagtttaacttcgagcccatgggcctttaaagcccgaattccaaggcgggaatttccgaaactcttacttctcaagtggcgggagaatctttataagtcaagccaacgtggcacatctcagccgtagatttgatttctcgaaatcaacggggtaaaatagaagctacggtcgtttcaaacgtcgggtttgttgcttttaatttcacttttgtttatttactaaccaaagcaaaaaaaactcaggaaccctcgattcgatctctcagacgaaatcaggattcgtagaggcgcgtcgatg

SEQ ID NO: 4954 - DNA, 2000 bp, Arabidopsis thaliana
gtcacttatatttgtgacaagtactaagttcaaaactcttcatacatttatataggatcttgagaagttttagacactttttttttaaaaaggcttgaagatatcgtgggtaattaacaaaggacgaaaaacaaatcaagtaggagtgtaggacaaaaaaacagtagttggcttttatttttaagttttttggtgaaattattggcctttattttaaaagaacatatagttatattaatgaaatggtgttcgtaaaaacgtgcaactctgacaaaatattctttaaataattggagacgggtagacgcaagatttggaactgttctttggtctcaacaaaagtcagttaatcaaagtttactaataagttttggcatagttgccttcgtaaccaagagggtgaaaacatgaaacaaaatagtgaaaacacttacagttatgttttagccttgctgtttgatcgtagggtggttggtatatgcatggtactgtcattttggtgaattttatgaatttgtaaaaccatataaaagaagaataagatatataggagcaacttccttttagagctttttttcatttaatatattactaaaccgtgtgagtggataaatacaagtctaaggaatcattttgattaaactcattgctactgaaagaatgtgtgagttatagggttataacttaagtactatatacagatatagtttctcttgttcgtccatatttatttaatctttttttgtaacttctcaaataatataaggttataacatttttttttttgtcgtctaatataaggttataacttataattatctttacacgggaaccacattttattgtttgttatataatctgtatactaacaacgacgtaataaaactcttacttcaataatctgacaagatttcgaattagtcactctttaagtctttattaatgcatgtaatatagttgagaacacattgactagagggagtacatttttttaaatggtgaacagcaaattcaataataattaaatatattttttaaaaattaggggatagcttctgattagctagaataaagagggtgaatgaaattatagtgtagcaatttctaaaaaatttagggtatataatctgattattcatgttgactaagaaaaaaaaaaatctaacctaaaaaagaaagatatgattcaacatacaaagcaattgattacccaaatcactagtcgttgggcattaactgctttggtgcaaatgggtctaaacatggaaggcttaggcctgagggatgccttgattttctttgagttgtgacgtgcaaactaaaacctatttcaattatacaccaaataagtaacaactagccctaggacctatattatatggaacattaagcttgcacgatctctacatttcttaaacaataaatagatctattgttgattcaattaatcaatttggtgtaatttttgaatgataatatttaaacattcccaaaaaaaaaggtaataatgtgaacatgcacgagataaaaaatacaaaaaattgtttgcttacacagcaatctaaaacacccgtagacgccaaagcactacagtaactctttcttttaggacagtgacttttaagttttactcaaaaaccaaatagacaaaacaaaactaactaaaacttaaagccacaaaggcccaaagaacaaaacaaaaagcaaacccaaaaaaaaaaaaaaaacagaaaccaaaaaaaagcaaagaaccgtttcttctccatcatcatcatcatcttcttcgcttcttcttcttcttccgtgaagaaggtcaaaaaacacaccaccgcttaaccccaattaccaaaaaatggcaaagcttcaaaatttctcaaattaaacaatctctttacttattcttcttcttcgaaatcgccgccggcttatgctgtttccgatcgttgtctcttctccggtgtatctccggtggtatcttccacgaagaattcataattact

SEQ ID NO: 4955 - DNA, 499 bp, Arabidopsis thaliana
atgcagatcctcgaataccaatgatgtctcagaacatcacctagctagtagtatcctgttgtttcatttgcaatggctgtgtttgtatgatctatctaagtaaacaagtggaaagtgtttgttaatgttactttttactccccattggtgaatcatggtgtatacctgttaaactttgagagcaagtggttatttatttagttagagagttagagcttctccaccaccatattgaataagaagatctttctctcattcttttactttactctggcgtctgaaacagatccagggattccagtagtgaattgggcttaaaaactgttatatgggctttcgaaagtaaaaggttcggtgagctgccaaagaaaagtcagatgcctttaatcgcatttgacgacgattctttacgtgcgccattgactgcatcgtcgtcttcctcacgcgatttggtaatccgattcgtcttcatctgattccctcccttccgagaataata

SEQ ID NO: 4956 - DNA, 2000 bp, Arabidopsis thaliana
cttgattcataacaatatgttgtttcttctagttttggtccccgcttcctcaccatctctagctagcatcatacattttctttattttataatatatattttcgacatagcatgtagattttctatttatcttttttaaaatttacaccaatcattgatagtatatgtattgtaaaataaaaataaaaataaaaatatctacaacgcatggtcatattcaaacttaattctaatatttacccaaatgattttcttttctagcggttgaattaacttagaaaaagaacaatcttcacttagagatcccagtgacgatttggacgcttaattattagggttatcgactcttattaaggttcttctaaagaaagaaaatgtaatactttgaagatgaagcaagacaaaccgaagaagacagcagatatatatatatatatatatataccgaccaagattcgtgtacgtaaaagcacaactgagatatgaatttgttggcatgcaaataaattacagatgtttgatgctaagaccaaatgaaattaaaaagggatttagggattttgtatctgtgagaggaacagtccattgaatcagtgagataggatactttaattatactgtcttcttctgctcagcatggttcgaatccccatatcaatcatccattgtctctttcacctttgttttcataaatggcaaaaactttggttgcaatttgcgacaaaggatgacgtattcggcgccatttaaagttggagttttaaaagtaaaaactattactatatcatgtgaaaatataattagattgtgaagtataatttttagaattctgtcgtttacctcttagcattgttatttgattagactaaactaataattcaattaaataacaaatctaattttttcatagtcgaatttcattagttaatcgtttagttgtttctctcgtggatcttcacatcatcacatgtgccaagaagttaatattaatatatagtcattttccgagaagagtctatttgggttgtttgagtaaagcgtggatatctttttccaaagaccttttgagaacttatcaaccacaatcccttatatatggttgaagctgtgatcacttgtattacaattatattaacaactcaatcggcattaacacaattgctttcgattggatctatcagaaatcggcattaacacaattacattatatatcacgctaggtctgatcagctccatgtcaatctcgttgtttgtgtgctctcggtttagttatgtgactaagaagatgaaccgacttggataattgattgcctggttgcaatattttcgaaagtgataggatatcaactgtttcttttcaatccataacttacatacttaatgatataaccacatatatatagaatcgtgtggctgtcccgaaacacgtgaccataccatatcgtattcgaatgcacctacttatcaactatttgaactgatgtggatttaagaattggtcatatattatcctccatgcttcatagggtaatatccagagcgatgttgcaacagatccttacttgatgcgtggccaattgatgttgcttgtgtgagttgccatagatcctaaagccaaggaatacattttggaatccatagaagacatgaacaacattaagcaaagccttctgtagatttttaattctttttcgttgttgaggatagtgatatgtacattaattaatttggttccgtataattttttaattaattagcgtaacactccacccgaaaaggtccaaaaccttaaacaacacacgaagctcgtagacaagctgaccaaaaccttattagttttgtttgcaaaccccaaaagaaaaaacatctttggtgtaacaaaaatggcttcgtcttccaaagcactgatcgaatccataggctctcttgacaaagactcatacgtttctctcttatcaaaactcataggcgaatctaaattcgtccagaacaatccgccg

SEQ ID NO: 4957 - DNA, 2000 bp, Arabidopsis thaliana
cgaccgaatattagttcacatatatcttagtaatttcttatgttatccccatagatatatttgtatagatatgattcctctatatggttaattaatataccttctaggctagcttctagccatttacttgttcttctgcgaagttgttaaatatactctttaaatatatcatcccacatattgttgtgaatatcttgggttggcgtattatcatctaataaaggtgtttagttatatttgacacaaaagataataatatgggaatccaatgaaaaagaaaagaatttgcattatataccatattaattttttctatatgatcaaaattgaatacagatgaattgcactgttatttttcaataaaacatttttcttagcatattgacaaatatatttcaactattcaataaacaaaataaaaaacaaatagtcataaatggctgattctgattagttaacgaataaacgtattccgagaattgcagctgattttttattaacactaggtaatcattcgcgttacgctgcgatattttcagattttttgtattgtttaatttaaatataatttttaattatctaatcattcactcatgtaataagtaattattcttagtattaaaatatattttctaacaacattctcaacaacgcattatacacaaagttcctaaacaatgttcgtcttaaaccaattaaacagagagtaatgttgggattctcgaaacctaaaaatttgatgattaaacttcttacatacttttcaccctcggcgatttattatatagatatatagcaatatgcaaactattcaaactattaactaatgcatgactattatacactcataattagagttaagattacgaaaaaaaatcttcaagaaaactaataaaataattttattaaaaacatgtaataacaaaataaatttagtattaatacaattaaatatgtaaaattaaataataaatatatgattaatctataaattaaaaattaaagagcttacattaattattcagtggatacatgacaaatgctaaaatgatgatatcatatgaaaaaaattggccaactttcatatatatgattgtcgttatcattcatcacttctcttttcgctactcgtatataatacgtaaatatgtgtgtacatatatgatgttatatgattctcttctcacatgaataatcaaattcgctgtggagtgatcttgtcatgaaaccatgtcaagacaagaaatcgtaatctaattaaaatggatcaataatgagaggtcgaattccgttaaataaattaaagattagtaaaacttgacatggtatatatccaaaaacagtgtggtgtaatggtattgttctcttacaataatatgaatctcgtttattcttcttgcgggcagaaaaaaaaagtattaatttataaaatacttctattctaacgaattatttgcgccgagtaatcaagaaaccaatattatattagaacttcacaaactcaagtaaactcaaaaagataatctaaactaaaaagtacaaagacttggccatcgattggattatctataggattaataaatagagtatctcacttactttaacttatatttccatccatactttaatattaatatccgttgatattatacttactactgaaatctctctctctctctcatatcaacatgtagaaggggaagaagatgttcttctcatcacgaaaagtcagcgtctctctcttcatcatcaacctttcttcttcttcttctcaatcttttctcaagaaaatcacaaatttcccaagaaaacactcacatatatgatgctatatatagaaagatagtctcatctaattctctctctccctcggattcgttagatgtgatcattttttcttgatttttgatcagattcttgcgtatagctgtatatatacaccaagatacactcatcatcgtcatatatagattatgtgcagcgtctctgagcttcttgac

SEQ ID NO: 4958 - DNA, 2000 bp, Arabidopsis thaliana
gattgagacagtataatgtgattatgcaacatcagcattcaatatatggtttcatgcatcttctttcttattagaaactccatagaattaagatttgatcgatccttaaatctctcaagactctactcatcacattttggattattaataagaccaggtaatatttgtagggccgaagtacactgttctatcatcattgaataaagaagctttatatcataccgaaaaaaatatgagttaaaagaaaagtagatcatatatactatacgagtgaccacgttaaatatttatgggtccatgctagaattgactagaccactacagtaaaatttaaagaaaaaagtggcattgcttttgaattatatattcatatgatttcaattaaaagtgcacaaatggtttatttatattaattcgaatggtttgtttaccatttaaaaattacattccttcatgatctttcggtatgtaactcatgcctcgtgtcgcgtggtaaagagatggtacatagcttaattttatttcttttggttggagctactgtatatgggaaaataattcattttataagtattttttttaaaaaaaaaactcattttcattttagaagtccatatgacaaacaacacttgaaactaattattattgaatctagtaatttattgaataatttgactttaaacttttgggcttcgaaattaaaagtcataaatgtgtcctaagagtgttctgatattcaaaattatttttatcaaataacacatgttagtgatgataagttgataaccataagatgactataataaggaaagaaatggtgatgtatctctctctctatataaattttgccgaattatggaagggtatgtatttcatataatattccatgagtatatttttgtctttgtccaataaagttattccatgagaatcttagcaccaaatctttcactgttttagacacatgcgccaacgcccaaacaacaaggcacatcatattgtgtaaaccgccaccacaaccattttattctcattaatattaccccttatatacatccaaatcattctcaacaagaaaagtgtatatataaaaccccctgcaacaagaaaagtgtaaacttcaaatttgttactggagtcggttttggtcgagtaagtcccttccttttccaagtcgctttttaggtttgttgttgtatgatgtatattgttcgcttctccaaataacttaaatcaacgaaatatccaagatcaaccaaatattgtcgaaatcttttcaatatccccaataaaactagtgtatctctctttttgcatattcaatactaattagtagttactcaaaagttcctagaactcatgttaggcagccaatttgctaattacactttaaaattacactttatttttttttgccaaatctgtaaatatcatatatatgaagaaagttttggatttacattttgattaccaaaaaaatgtgactaatttgcttaaaaaaaatctcaaaagaaaaaacatgtgctaaaattctcaaaaacaaacactatgaacaaaaaaactatgctcatggaggaacattagtcgccatgctccattaaaatctacattccaagaacatgtataactttcgtacctacggatcaaccaaaaaaaaaaaaaattgccacaaaactcaaatcaatgagaataaggcaacacgtacacacaagagtgaagagtacatttgcacgatacaacacacaacacaagacacaccacgtaaaaaaaaacaaagaacacccaaattacgaaattaccctacttgtctcgatactctatatacgtgagtatacaatcacatatatttgtaacagaaaacaaagagaaaaagcatataatatacatttatataataataatcagagatatatatataatacacatagcagagacccaccttgttgtttatttctgaagaagaagaaaaacagagcatcataagaagaaaaaaaaaagca

SEQ ID NO: 4959 - DNA, 1360 bp, Arabidopsis thaliana
cttcgcgctttcttgttaacagtactctctccaatgcctagtctctccctatatacacatatgtgtgtatgaacatactattttacaaagaaacacctttagatctagatgattttgacaaatggatcgtttgactatcaactaattaagtaaaggctacattaatataaatatagaccaaccagtgtctattcaacgcacaacactatatcttactataaccgtgatgacaagtacaaaataacattaatgatgtggttgttttattcaaagatttaaagcaataaaataaaattcatcatcaacaatacaaagccatcgtatgtaaaagatttattctacatataaccataggtgattgatatttcttgtacttatcattggatgagttgtaggtttgttatgttggtatatatactaatcagatcttcgtaataattctatagctaatactacgtacatgcaatcattttttcttttgtcaaacatggaataatttattatttaatagaaaaatgtatcttatagatgaaatattgatatcaactttgcgtctttttctgatgattaaaaagtttgaatccatgtaaccatttccatataacacctgtaatgactcatgtattaatagccgatgagactcgaattcatatgtgttgaagaattacaattactagctactagtttttctgttgatctaatgattcattatataactcgagggctcacaaggttatttacaagggaaattcaagttccaacacaatacatgtttggtttcttttgtcttatcaaattttgatggttggatagtgacttactaacgtgtgacgaaattataaggtttaagggcgaagagtaagagggggaccagaaacaccgcccatacataggaggaaagtcacagtcaaaaattcataagcacaataacaaataatcccataacttggcttcttatcttgtccctttctttacttaaccctagtttaccaatcacaaaccaaagttagacccacatacacatctcaatattagtttaaataaaaccccaccaaaacctcctttttcactttccaaatttcacttcctccaactcaaagaaagagatcagaagctatagctatacaccaaaactaggtatagagagagaaaccctacaaaatcaaaaggaagaagagacgaagatgaagaagatccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatc

SEQ ID NO: 4960 - DNA, 361 bp, Arabidopsis thaliana
aaccaaacaccacacattgtaatttgtacgtgaaaagaagatcaaagtgaacaaatttagttggattatctaaatatcattctttcatgggaattatgttgaacacgtggagggcattatttgtgaagttgaaacgaggactatttttcaaactttcttgaggaacaagacttgacttttgtaaccataaagatagaatcaagtcagattttgctacttcgagaacattggtcaatgagtcaaaatgtcaaatagtcaatactaaaatcaaaattgaactttgtttattaattttgttctaatctatttaaccccacaaaagtttccaaaactgcttcactcaccaaaatagatctaaaac

SEQ ID NO: 4961 - DNA, 1953 bp, Arabidopsis thaliana
gactaacaaagcctcccctttgttatgagattcttcttcttcttctgtaggcttccattactcatcggagattatcttgtttttgggtgactcctattttggatatttaaacttttgttaataatgccatcttcttcaaccttttccttctagatggtttttatacttcttctaattgattgattctttatggttgtccaagtgtcaaagtgttccacccatatgattctaaccttttgatgagcgaagtctttactcgtgcgttatgtagagacgtagaagcaataccacaaaagagtataattatagatatatgctaacaaaactcaaaagttaagatcagtttagtattcaaaattgaacagtaaaaggttaaaaaaaatatgtatacttatgaaaataactaaattcatagataatcttttaaaattcagagtttctttttcttatatcaaattcaaaatgaaaacacaaactaaaataaacaacgacacatatcataaggtcttttatattttgtattagatcaaaactattattgcaatcacatttcttgtggtaataaatgaaaggaattctactcctaaagccaacgtgtgtcccacacaaagtaagaagaatgtttatattatcttttgctcttgcaaagtcaaatgtatcttcaaaaagtcatgttgctagttttcttttattcccctcacgtcatcacggttcctcctcctattacaaatatacacacccaaaaagtccactaacatgaaatgctaaagttaattttagaaatccattgctttcacgtgaaaaaaaaaactattacagaaataacatgtatttatacagtttactaatagtcatcaactcatcatatatggtataaatatttgtcgaaaaacagctctcatgatatgtgtaggcttatattcgacagcccattaagacacaaaatgggccttttaaaaggaatgtcagttgtcaatatctgattcgtacaacgtggagtagctgtggccttgtccggttgtctctctctgcctcttcgctccaggttcaccgtacaataataacaaagaccgacgcttttgtaaaagtgaaacctaaattgataaccaaataatttgatcaatttggtacaacttttgttttgactgatgttcagattttcttttcttcttaattggtatagttttattttctttttaaaatgtttggatttgtaattcatttagcattccattctaataagatttatctttttctttttaattatctctttacatgatactactatactatttgtttaaacaaaaaatatagatatacatgcatattccatatttaattaatgggatcgaaattcaacattaaattaatgtacctgtaaaaaattaaatgtacaaaacgacagaaaaactcaaaaaagcagattttaaacgttatattttccaattttctactgcctcctgaaaaattggatttggacatgtctgaacattactcaaaataaataaatttagctagtttttgaaataagaaaacatagtaagtaccgttttgaaggagaaaaaacaaataaagtactttttacacacgaaaaaaaagaaagtaaaggaaagagcttgtttcacatatatctgcagcgtggactttctctactgcgaacccaaaaagttttttaatctttttatgtttccagatccgttttaagaccagaagtacaaaaaaaaaaaagaaactcgaaatctccattaaaagagcctatcgataataaaaagaaaaacaaaacggcaaaaaagtgaagcgaaacacgacacggattcacacaatactcagatatatacaaaaaggattttagattttgattcagaaccaaaaataaaaaaaggaacttttttatttctttgtttgattttttgggttgttggttttttttttgtttgttaattttggggatcg

SEQ ID NO: 4962 - DNA, 2000 bp, Arabidopsis thaliana
ggttcttagactggcgagaaactgagagagatcggtggaggaaaaagggatgaaatatatagaagttggattttgcttcaattagggttttgatttgatgatttttttttactgaaacagaaactgaacggtgtttctaactgtgaattaggatggtgttaagatggcaaatattatatgtaaaaactctagcgtaaatatccaatgagatagctagttagatattgttttggcaaatgctaggtgtttttttggtatcatttcccctaagcatgtgtgtgtttaggtttttgattaaaactagcaaattctgtggactgcaatactcatcatatatgccaaacttcgaaatcacatcaataataacctcaataaatgtgaagtaactaaagtggaccctttgcctcttgtctttacatatgtaatcatccatttatgaacggaatcttatgaaatttatgaaccgataagtaattaattatttattttaatttatagtcttttttctaccccattggtaattttggaaaccaaatatccaaagcaacctctatcgctttacccccacccccatgcaggtatacgtacaaatgtgcaatttggtcggtcaactgggtcttagtcagtagccaaatgtctccaacattaaattgtaagagaagatggcaatatgcattcatattgtaacaaacgtatatgtcctctagacgggcgtgatctacctttaagattagttcaaaagcataaagtcgactgatagcacaaaatgatgtcttgccaaatgtgtatttcgggtagttcgatgtttttgggatcggcaaaagttatttgagaagacattcatatatatatatatttttgatttacgggagtagggtaaacatagaacaatacactttatagatatttatatatacaagagaaatgtgtttttaattaggattagctgggaaaaagagaggctggctctagatcttttatacagacacctaccgacttataattattatcactgcacatgcatgtggatcatatatattaaaagtaaattacatgcataacttacattaaaactaattattcattattcttgtttagtttttgatacttataaaattttaaattctttatccataaaactagaatttttttagaaatataccatttttactatgtgtatatatatatatatatatatatatattttaaaattgaccatatgtgttgtccattttcaattatacatatttcaaaaataatatatttaatgtctgtgacggcttatagtggttgaataatcattcatatttataaaatcttataattcatttagaaaatcttgtatttaaattttttttttataaaaaatcttatatatcgttatacataattgaaaatatacaatatatgcggttatttaaaaaacatattacttggatatttttgaaattcccccataaaagaagggattttttttgaaatagctacaaagaacataaattagaaagtatgttgactttattcgtaaattataaatgctagtagattttagagagaaaaaaaaaacgaaacctagtttttcttttacgcaaccgaaacctaaaattattaaattgataggtttgacatatataatataataattcgatcgaaaaatttgactacagaaatctgaaatcataaacttggtgtaatgtaaacatacatatctcattaaacaaaaaactaatatataaaataattgacttttgaaacaatatattgacttactagtgtaaaaatgggcctacctaaatccagctaactcagcccacacattaaaaagaaacgttaaagggaaagtaataaatgaaaatgagtcactcagagacagatgtctctatctttcacagccaaattcacaccattctttattttcatttttccccctttgcccagattccgacaaaatccactcgtttgattccaccactatatataattgagcggagaagcttgac

SEQ ID NO: 4963 - DNA, 2000 bp, Arabidopsis thaliana
tggtaaacctcaactcttgagctagcttttgggtatgaggtagactcatactaatatgaaatcatatttttatcatctgttagaaaacactagtccttttaggaaataccaaaatctacaggatgtaaacataagggatagtggagaatctatttaaagtgaaatggagttggtaaattgaggcttagtactacataggtcagtttgttgacttctaaagtggctttgcattcacaagtatgaatggtcaagcttagcgtttggtggtgcgatcaataaaagattaattatcattagtattaatgtattatagtatcactatacatctcttattaagtgctatacatcacagatacccacaaaacaatttgtaactcaatttaaaggtagtaattttttataaagagatttcataaatctaaatgaaaagttaaaggacagaaagtaatcaaagttgaaccaaacaaccataagaaagaagggaatctggttattaacatagctaaatttgttagttagtgtattttctagaatccaatatttatatatatatatatatatatagctaaataattgatgatttttgaaagaaaattttcctaaataaaactattactatacctccccaacatcaatccggctaatagttacttaatttcatgcttaattgttgataaaataatattttgtataagttatacatacgatcaaaactaataatacatataagggtttttaatatataacaacgccattctaaaaaaattgaggcgacaacaaatatattctacggactatatagttttgaaggttaaaacctatatatacttgctaggaaaaaccaatttataatatttcgaatggtgtaagttttttttccaagtaattaagtaagagttgtaggctttctatttatggatcatccactatttttctacttggccactcactataaacgtaaaacatattaaacgaccaaaagtaatttagattctatcttaagagttaagactacactgttacataaaatattttccactcttaaattttctttctttgctaaaaaatttaaagttgacaaaaatatctaaaataaaccataataactataccatttagttacagaatatttttgattgagtaggattatgcaacttaagacaactctctaagatttattgtatattttattcaaatataaattgaagaaaatatattaaatttttgagccacaattactggagatggtggtgtcagtatctttgaaataatgaagaaattgtcccctctaaagttaaaacccacaaattatgacctactttcaaacaccatatatttctccataaacttggggtcttaatcaattaattataaaaacagattgtacattaacattttccttttttcattgacacgaaaattttagaaagaggttatccaatgtcaataatgtttcatttcagattcggctcaaaaatagaaaaatatacaaataatttgaattaaatataataatgactttttcttcgaactcacagtacataaggcaacaagtgtcagatttgatgcatagagataatagcatttttcgtagtttttgttaaatataagtataatacaacattccaaatttctattacagatttttaactggatcggataattagatcggcatatttttcaagctttcagcaaaaacgatcaccctaaaattattttttttgatggaatgatttgtttgaggatattgaatatatacactccaattccaaaaaggctataaagtatgaattaaacaatcaagtagtaatagccattattaatgattcgaaaatggtaaagaaataattaacactaaacaagagtcaaaagaacatgacgtaaatattacatcaactttacgtataaaccccttccctctctctatttaaacccaacacatacatatgaaactcctcaacaaacacaaaaacctcacaaccactaaacaacacacaaaa

SEQ ID NO: 4964 - DNA, 2000 bp, Arabidopsis thaliana
agttgggacttatttacaatggctgccactggattttaatgtttgtttttgataattaaaaataaaatctttgaattaaatatttgacatttaacaattttcctaaaatctctccacattaactacacgattatttcctaaaataatacttccaaattatttaatatcatttaattactataaaattatcatttttgatattgattttctccataactataacaattcgattataatcatcaaagcgcagagatataatctgatagcatttaattactacaaaattacaaaatatttagacaatgattcataagcatatcataaataagatcaacattaataaaataaatggttttttttataggacgggtttagcaggacgttacttaataacatttgtaaactataaaataaaattattttatagatagatacaatttgtaaacttttatatatactaactttaaaaaataaattgttcccgcggtatactgcgggttaaaatctagtacttggcaaaagtttagctttaggagttgtggtttgtatttttatttgtattttcaaaattgtttccatttttaggttattttcaaaattttaaaactaaaattatattgattgcacatagttcagaattatattaaaattattatttactataatcaatacaaacattaatactaggaaagcaaaattaactgaacgaaatttggttcgaatcggttcaggtaatatttaattcgattcggttatttgactaaaatctatacagaaactcgatttcgtttgatttgggtaaagattctaaagaaattttggtataatttcattaaattcggtgtaattcaacataaaattggttataaccattagcaaaaaaaccgaactcatttcaaaaattggttaagagaacttatttcaaaaaaattggttaactgctaaccaaaacacattacaaaatgttgccgatcaattcactcctattaaccgacccggttaacggaactcccaaatatttgtctcgtcgtcttctgactttctccttacaaatcggatttgttatccaaaacaaaaaatgtcacatttctttaacttaaaaactctcccgtttcgccgaagcttcttcaatggcgatttctctcgccaccgcctatatctctccatgttttacaccggaatcgtctaattccgcttcaccatcacgaactctttcctccgtacgattaccttctcagattcgccgattcggaagtgttcaatcgccgtcttcgtctactcgcttcgctccactcactgtgagttctccgttcaccaattacttgtttcgatttgatgctattgattttgagacaaaattcaattttgttcttgttttagttacttcgagtagcttcatggtgtttgtgtattttcatattattcattgtttatacataaagatagaatcagtaatgttgtaaatttacatagttttacactgagattgattcgaattgaaacaagaaggagaatgtaacacattgattttagtatattcaacatcgaaggactggatagtccgaatttctcatgtgtattagtgaagctaatcgtcttgccgatggattagcgaactatgcattttcattacccctaggtttgcattggttggagtctaggcccgatgttgttagttctattttgttagctgatgttgcgggggttgcacaccccagacatgttcgaatgtatttttttctttttcttttaataaaaaaaaaaacattagagagtgtgattctaacatagtgtttgacgttgttctgtgtaatctaaatcagtatgtgtaatcagaaaatgagaattgagatgtaatgaaagaatgaaagaacatatatgttagtgaattgttcttctacttctaatgtaatgttgtttacgtctagtagaagtagggaaaatttgttcatttgtttttatagtagaagcgttttcataatttgtggcgcgatgatttg

SEQ ID NO: 4965 - DNA, 2000 bp, Arabidopsis thaliana
caacgttcactaaaagagggagagggaccattaaacaaaactggtttgagttcctgaatttttctattatccataatttgtataggtttcaagtgttcaaccaacttttgacttatattaattttaattaagtttaaatagattctttcaacgttttaaaaagaatatttctattataaaaatgtataagtattgtccatgcaaaacgtggataaacttctctagattttatgaataatttttaagattatgatatttcttgagacaaaagattttacatcatattataaaaataaataaaataaatttacatcaataaatatcacttatagcattattatagcaccgaaactgagctcatgagttaaataaattttgcagatttattaatatcatgagcccactgcagctagagccaaacaactttaaatttgactcaccaaaaaaaaaacaactttaaatttgatatacgtcttatatcgtgaatattcataccttccaagtgcagaataatgaatcaaaaacgttctattgatagagaaccgatgctcctttttctataacaaaattatatggaagaaaataatgaaagtgattccaccagaaactaagtggcacaatggaaacagtacaaaggacccaaaatattggcgattatacgcacttacatcaataaatattccatgaactaaaataaattacaaaataacctaattaaaaaggaaaaaaagcaaatctaaccaatgatcactctacccaacagtgtcggtatatcgtgactcattaatcattagttcatttttatactttatagattggaaagaactcgattcatcaacacctctcctggagttaggcgaagatacatatatggaacattagtgaatgggcttggaataatttacaaattatttttcttatataaatgatgaaaaacaaattatacaactcttattctgagtaacagctcttgtatttcacaaaaaacggcacaatatcatatatactgttttacacacacacacacacagaaaaaaatcatgaaacaccacttaaaattttctctaatttccaatacagacaagctcttggattagaggcctaatttgtgttgtaattggtatttatcaaatcattcttaaactatgccctatggttcacaaatcattcagttttctatgttttaataatctaataaataaaattagcatttacgtcaatattttttttttgatatatactctctcggctcattttaaataatatataaagtctttgtacatagattaagaaattatatctctcttatactaaaattttatttttacatatctaaaaaagttcaaccagtgaaaaagtaaatagaagaatagaaagaattaaaaacaataaaaaaagacagtaaaatttacattgaaaaattaaaacatcatacaaaatgaaacaacaaaaaaaaaaaaaaaaccaaacatcaagtaatatgaaacggatgatacatttttaacaatacattttttatgcggaaatacatgatggtagttgacatgatggtaacatatatacaatgttattatcatgaaaatcaatcagatgagagatagtgatactagcgttcgactttgatgaaatttgcgaatccacggcactctgtattttgtttaattagttcggttatgtgacgatcaaatacaaatttctatgtctttttgttgataaggtaaagaaataagtcccatgatttcagggtacggtttggaaagtagcctcaaaatacataacaaaaaggaaaaaaagaaaatttacacgcatatttatttacactaataagtttacgtagagagaagaatgttcacatcacatcacatccttttaactttggctctatataaagagagatagccaagacaatcataacaactcatatcaattttttaaaaaaaactctccatatatctattacttctacgctaactagagagggagattattgctcttaagtg

SEQ ID NO: 4966 - DNA, 745 bp, Arabidopsis thaliana
atagttgttctggaaatccatcagtgagctgtttcagtttccttcaattcttgcaagtgtgaactgctttgcttactatcttctctaacagattgagcgagattcagtgggcgggtttcattctattgtgttgcggatgcaccactgctcagttgaattcaaagtaaaactttacccttgattttcatatgaattctattaaattgagctttaacgattcttgcatatgatgcgtaacacacaaaagctcatatccggttcctgctctgtgaactttcaggtctctgctgatttttccaatatatgtctcatatttgaaattgcttttgcagttctgatcgtgttcttcagacatctcttcctggctggactatggcaattgtaagctgttagccccctttgcaagctaatatcaactaagagttgtgaagcagctttcatgtccacatcaattaatataatcactcgttgtttctaggtcatggctcttttaagtggtttcgccggagtgtacacagaggtgggatattaggactgtatactgtaaatactcaaagctgatttggtttcttttctctgtgtgtgtgtcaacactaatacagtataattggttccttccattgataaattaacttatgatatataaagcttataaaggttttgctttccattttggcaggccattattaaaaagcgaccttcaaggaatataaatgtacagaacttctggctatatgtctttggg

SEQ ID NO: 4967 - DNA, 649 bp, Arabidopsis thaliana
catatatgaaaacgattcaatttttatctaactaatgtacaacaactacatgatcatggtatatatacatagaccttggaaccagccatttatacgcaattctccattttatcactcagactgatagaccagcaacactagtatagacgtgaatacgaaaattcacctcgtaatcgatagtgctggtggatacggcggataagcaattacatgagaagctattaaaccggtcggggataacattttgagagaatcgccggaagccgcgacgtcggaggctgtgaaatccactgaaaacgcgaggagaggaacgaatccgattcgaagaaaggaaggtcgcttgagttgtgacagggtttagtgaaggagagttgaagattatagccaaaccagaagcaaaagcagccattgatgattgatttcaaactcactcactcagacaaagtatcactacggggataagggaaagagacgaatacaaatcgttataatgggcctgggtcaggcccattagtttaaagtttttttttttttgaagttttaaaattgcgttttttctggggtcatctaaatttcgtgtgattttctaagacttgagtaatcttgttttccgaaattttctcaccaagctcgaacacaaagatcggcc

SEQ ID NO: 4968 - DNA, 2000 bp, Arabidopsis thaliana
tatagcttttgggccttcctcgtcttcagtttggacagctacgtaggattctatataaaatcacaaaactttagaggcaagtgatgttcgtcttgcgttaggactgctccattgcaaacaagtattgtttatggatatttgtgaaatttctgagtgaaacaaacattttccttgttttcaaatttcaaccaagtctcatggtctgttttactaatattagtgtttaaaactctataaaacacatccttagtatttttcggattaccacatgtttgctttttgttgaagaaaatttatctctagtggctagacatacgaacatcgaaaatttagcaaaacgatttcttttaaatttcattattttcaaataaaacaaaaatcttaaaatgcttggatttttaaccatttaaattatcaccttttagttttttttcttttttttttcgtgtgcaaggattttattgattaaatgcgtttgagttatacagagccgaaaatgaaaaaatcttttcggatacaaagccgacgggtacatagaaacccccagagacatgaggccaaaaaaggcgaacaaacaaaacaagccttaaaagaaaatatacaaagataacagttacaagtaataggtaaagcctccaaaacaacaacactgaaaattcttcccaacaagcagccgattaacactttcatggaacaggtaacagctaccgaagtaatagttaaagtctccattttcttctgttttatagaaaatttaggtaatatttcatatatatatatatatcactcagaaattacacaaatattcaaaaaaaatctgaacattgggagcaaactttttgaagcaaatcagatcataaaattagataacccgtagttacaaaaaaaatacttattgttctataatataaactcagctctaatcagattccatttgctaatttaaccgtataaagatatttctaatttacaagattttaaaatacgagaatgacagtaggaattagaaaaaactaatataaagcagaagaatataatcgtcaacacgtgataaaataataacccaatggataatttaatactattacagaaccaaaacaatcaataagcaaaaaaaaaaggcaaagtcccggaacttgcgtcagaagaattttgactagaaagaaaaaaaatcaatttcgacggccatttttttctctcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattaggtgaagtgaaagttttcttctttctgtagtatttgagatatttttgtttgcgtgggtcaaatcaaatctttatccgatctatttggtgtgagtattggtatatagtcatcaaagtttcaatctttatctattggaatctattcaaaagggcatttttatccattattggtgtgagtgatgatttgttcttgttgaaagtatattttatctgaatattcatcacttacttattagtttacttatccaagttgataacgaatctattctaaatcatgttcatcatttttagtgggttactttttacttctttactctttaagtttctatgcataatttatgattgttataggcagctaagaatatcttgggaaatttagtatcgtgtgttggttatactttaattagctgcttcttgtgaggaagttgactttttagctactacatcagaaggtactatagtgtctcttaaaagctttcttgatgaatgatatcttcttagttgtactaatttttgtgtgtcttctgattgcaataattgttgtccacag

SEQ ID NO: 4969 - DNA, 2000 bp, Arabidopsis thaliana
tgaggggttggccactagacaattttagtctatttaaatttggccttctttctaaaattttaatgttatgaatggaaaaatatttaggttagaaaaccaagttgttttaaaagaaaaattaggtcaatttaccaagtcgacaagttgctagttcgcttattgaaaagtgactctccgatgatcagccgaccattcgaccatttaggattttgggttctagatttactttcactcaaaaataatgtataaaatatgctctatccataacactaaaaccaataaaaataaaactttatgctctattcatttggcatatataaagtttttgagaaattgatttaagtaaaaataaaaataatgttttgagaaattctaatcaaatatggtgtgcgagttcctagataaaattggaacgttgtttttcacatagaacggatagtttctttaacaaaaatcattttaattaaacaaagacaatttgaccttttttattgcgaatggatcattgtagttaaagaaatcaatttgacattttagctatcagatttagcttccttattcacatcacacgccgaacctaaatttggaatattaatcatttcacaacactctactacttgtacatagttcatacctaaaaaggtctctgatttatatgttatggcagcacaagtcccactctctgcccatacctttgtattataatatctgtatatgatagttcatttatacaattaaattttcatgcatctcgaaattttactgtaagttattttgcacaatttatgaaaaaccaatactacaaaatacctaaaacaaaatgtgtttaatttattttgaagcttgtgatatctaaaataagtaacaatatggatattacaaaaaataaaataaaaattattatagttcatactagtaagaaaaaaagaaaaatggaaaaaagtactaacacgcatggtttacggacaactaacccactaaatgaagttaatttaaaatcatttaaaaagttgcctaacctaatccatgtctgcgcgtggaatctcatgcgtacttcagaccaattgtacgacagggtgctgtttccaattactccacccgcaaaatgaacgcgtgaaaaaccacgcgccacgtggaaaaccaagaatctttctgatggttcggaccataactccgaaacacataagacaatgacagatccaaacaaacaaaaagtaaaaccaatccccttcaattatcaactttaactgtttttgtcgtcttcctttttctttcttatcacactttcagcttgagatatccttaattaataatcatctctctttaaacttagagaaatattcgggatttatggttttcgtcttaatgaggacacaatgattattattttaatgtaagattgagatttcttctttctgtcataactcataaggttctctgccttcggtgtaatctaatcatatactttttattcaaatgatgtcggctcaactattggcgcattcttatgcgatcaattcttatgttactaatttattgatcaaaattgatactcacacactatcgattattgttttctacctaagaattattgcaatttagtcactacaaataaattaaaaaaactagaggcaaacaattcgcatggaaaacaaaaactggcaatttggatgccatgaaccgaaccgtgaatgacaatgacagttcatatgctcacattattactattttcttactacttttgagttatgatttctcaattatcctctttgtatttttaataaagactcaacaatttattccgtgttccataaccccatgaacacattattcgagagaaatggaatcagccaatcactctctttcctccatatataaaatctagccaatattcacaaataataactacttccttcgttcttttccttaccaaaagatccacctcgaacctctctcctccgtcttcctccgcagccgccgtcactatcaccgcagctaga

SEQ ID NO: 4970 - DNA, 1727 bp, Arabidopsis thaliana
gatttattgtattttgtattttcagactaagcttttgccttttggctgtattgtaaaacggtcatgttgttgttgttgttgttgttgttcttgatgttgctgtgaacacgtaaaacagtgttttgtttcaaaactcaagaaatgcttgcttaatttgtagtttgattaagagtgataatgatgatctttttcttttcttgttattagtacattttagctttctaaagttttattcgacttctttacaaagaaattttgcccatcacacaatttatcttttttcctttcctaaaatgtatgacaatcattacactcaaccatgaccatctctatctggtgtaggtttccacagcgacaaattggattgtttaggataaggttgagaattttttttcttataaagaaaaataaccagagagatattaaaatctagacttatctttggaagttctgaagaattcgatatttatggtgtttataggctaactctataattttgagctattcatttttgcttgagtgaaccataaagttggttccatacttccatgtctatgaaaacttgacgaaatgaaaatttcaaaacacggaaataattcaatttcaatcaaaggaaaaacaacattaatgtcggccattagtttaggatgaatattgtgtgccaataatagaaaaagagttatttgtttttaatttgaaactcaatatcctcataaagatattaagaaaaggatgcagcaattatttaacacataaagcaagacctataaaatccgtatatagatattatggctatcatacatagtgcaatctaaagtacaaaaaaaagttgatatttaagagtttattatagctctcttccaccttaaattgtatttttgtttctacttttccattatttgagttgagtaatattatctgagtcttaccagtggttacatgtttgtacgtattcagaaaaattcgtgattagatgtttgttttaatgatcgtatgataatgacatattgacatagtaggcatgtcgatttgataccgtatgaatcagaatccctaagcctacctaacttgattacatctaaatatcctaaaaaatatattagattttgtatagctatcgtaatttcattcttagaacaattcatgcatattgcatgcggacgttgacactaacttgctagatgcatgcaaacgattcacttcgattcaatattaatttattcgagtattagttcaatttcattcatggtaactcattgtgaacacactgaatggttatatatttttacccgattctcatttattaaaaattatatatatcggaatatcggataaaaccttgcaagaaaactacttagtacttaccctagaatcttgattatttctaattttaatcagaggctgcaataattcctacatagctagtgttttttcttcttctttaaaaccatgaaatctaagatacaacaattggtccttgttcattatatttgtttttcttttaaagttacatggatgcaataattatgctccaatagtaatacataagcttttgctttgtctttcaaatctttttataatctttgcacgttttagtaccactctctctctctctctttcgtcctttataaacccctcacatttcttctccttagctcataagtaatcaaattccaaaaaaaataaaataatacaaatctctctttttctctctaaaaaatcttgat

SEQ ID NO: 4971 - DNA, 846 bp, Arabidopsis thaliana
taaaagaaggaacacaagtagctcttttttttttctttttttttggtagcaagaacacaagtagttgacttatattttccgatctggataagcaaatctggttatagttaaaaacaaatgtatcttagtaatgtacacgaccaagttctggatcgaaagggaacaacataacatttactattgaacaatgatgtgatcggtaatacctaaaacataattaaagttgttaagaaaattgaacaacataatttaagagctcactaaagggtaagatatttttagatgaaagatagagagataaccattagtaagaagtacaataagattgatgaaaaaaaaaagtacaataagataaggcggtaaaaaaaactgaaaataacagcttttgtacgactaaatcttaccgttttaaaaattggtaaactagcaaatgggagtatgggaccattggttttgtaattgtgaaagaaaattaatcaaaaagaggtaaaccggtataaccgaaaacgtaaaaaccaggttaaccaaatctaagcgatccaatcaaaaactcaagaatggcgcaatgagaaaactaaagaagataagagaaatattttattttatgttttggtcgaaaagaagataagagaagattatgttgtgtcaacttttgatcgtttgaatacaaaagatagaaaatcgggaaaataaaataagcaccacatgttcagattttttcctaacaagaagaaaagaagtcgcagtttcatcgtctttcttccattatcgtgcaattaaattctctcattttcaagaaaatatctgaaaaaacagaaacttaacagaagcagcttcgatcaagag

SEQ ID NO: 4972 - DNA, 909 bp, Arabidopsis thaliana
ttatgttttacagatttctgttggatacttggatgtaaaaactcgttgctattgttgattaatgatcttttgatctctgactctaagcctcattgagtttcctttcatagtatggtctgtgtaggaactatgtaccttcaaaattgtgaataactagctttagcattggatttgattagacgtatggaagttagttttgaacagagagcatgtgacataacggggaacttgaagtagattatgactaacaccagcatttatgtttctctgccctcgagctgatggagttgcaggattttgtctgcctcaccatcgtatggaatgtgtagctttctatggtagttgttataagttttgtctccattgtccatatcactttatgggtatgtagatttgtgaaattaggcatttgtaacatcgtacagatgatgtattcttcattacttcaatacaggcatatagactctctgtccaacttaaaaggcatacaaggtctgtggtttaccaaaatcagctttactaaatcctttggccaatattctctcagccagtcctaagaacctctgctctaaaaagtcttagctttgaaagtcagacaaatggagagcagccttatcctccttttataaccgtgaccacacacacaaatgaagaagcccaaatgaaaggcccaaaaatctaaaaaataggtgaaggagggactttgtgaatatgtgatcatagaaacatgaagagacaagagagtggtaaaaccacaaccatagaaacaagtaagaaagctatccagaatctaatcttatttgcctccaagtcatcaattctttatcctatattactagtctctgcttcaccaatcctttttgctctcctgtctgctacaaaccttaacttggattctttctggtcacc

SEQ ID NO: 4973 - DNA, 2000 bp, Arabidopsis thaliana
ccccaactaaaacaatctaagccgtttctgaatgttttccggatctgctgagtcataaatacgagtgctttaggcaggcaaataagactccagcatcaatttggctggggaaggtgttaaaatctctacgatcaggtacgtgtatttccattccttctctgccttgtctttaaacatctccgtgtacactttccctgctccttgaggcccacggatgtagaagtttacctgaagcatattcaattttgatcatgttaaacctgcaaaactctagacaatttatatagcaagaatgtgaatccaagcgcaatagaggttctacaatgaaatacctcaacatgctccactccgtcttcatctgtaaatactctgttgggtatacgttgacgagcagctcggtttctagtttcttgtccatagcctttgatgggggatccaatcctaaccctcacctagttaacaagacaatcacagtcacagaaattgtttcattttataaacagatgcttttgtttcatacaccacccctccgctatgatcaatctgtagagttagtttctaattacctgaccatcatcttgaattctcttcaaggctttgtcaaagaccttgtacctagaatacataatggtgtctttagattactcaaatccaagtgtctgagcagataaatcaaattagatttctgaagcctcactcttttggttgaaaaatgagctctttaaacacaccgtagccagcagctccagcgacaccaagcccagccagaataacaagactgtaggacgcaccttctgtaaaggtcaccggcttctccgggatgtggtatgtaggagaatcaaaaggatcctccacagtcgtcacctctttcttagcctgtaaaacaattggcaaagcaagcatcattattagatgacagaagctgtctgtcgcttttgacggcttgcgttgtgataaatggcaaacacataacgtagacattaagtagaaacttgtaggaagaaacaccttattctgctgattcccaggttcttttgaagttcttgatgcaaaagatctggtaaagtaagatgagttgatgttctttggacgagcttccgtacatatacttgcttgcgggtttcggaagcgaaacaatagtcctgtataacagacaattgtcagaacaacaaggtacacatcaacactaggatttgaagtttgattacacaattatcactgctgaccattagctccagtagagtcctgcataagaaaaacgatgagaggtatgagactaacatataagcccaaaagggtgtaaagagcaaagaaaatgttgtcgaagcaaatatttaacaagtaaagggaagaaaatacctttgaaagaaatgagttgctaaaaaccctcttggactgatatataacaaaagtaacactgtaagttttccccagatcaaggacactagagagattcaattcaaacaggactagagacactgaaaaaaacgacctcaattttcacaagatcctaaacaatccgtgtctatgtagtagaagaaccaatagcttttagccaatattatatagaaatgccggcagagtgagatggaatacgaaagccttaccgattttgggattccggaacaaggttgtgtagcggaggaaaacgacgccagtttcgattttgattggcggccgatggctatcgctgatctccttaaaagattcatcatcatcatctctgaaccaccaatattactgattgaaaaatcgaagtggagacgacgacgacgacgagcgaggttgaatgagcaaggcaaagccgctcgccgttgctggggttttatcgtagacacgtgacgcgcacgtgcaagctatttccttgggcttgggcttagactcatgagataaagcaaataaaacccaaatgggctttttagaaaagaaacccaaataacagagtatctcttcttcttcttcgtgcaacaacctaaccatggaaattgcaatttgcaaac

SEQ ID NO: 4974 - DNA, 2000 bp, Arabidopsis thaliana
ttcttctgcattattgtcgccattatccttttttgttttgtaatcagtattttatcattaaacgtgacaagtactgtcttcattctccaacacataaaatagtcagaactcaataaataatcataaaattgagtactctttggcccctgtatgattagccgttaaactatcactttcgcaaaaaacttcatgtgattactttgatatttatatgtactaaaatagttttttttcttcgtcttatgttcgcatataacttaaaagataaataactcctacgaagtatatgatacgtgactccaatcaaaatctttgacttgtgagttgtgaatatgaatttaagtgaaactgtcgcccagtattttttacggtcaacagcatgtggatacttttaaatatttttgtttaacaaattaaagtgaagaattttcgttgtctcgtgaaggttttagtggtatatatatcagatttccaaattttgcaagatttattttgatacatatatgaagttacaaaacatacaattacattccaacgttaacattgttttactgtgataactgataatgtaatcctgcatgattttgggtgaacttaaaaacgaaactactgaaagttgcatgtcgttttgcaatcataatgtgggcaacacgaaaacgagctcgaacgttggaaatattggagaaactcttaaagtccgtgagaggtttacatttgggagatgtgatgattggaaactgaatgtgggacaaaggtttaggatcttcaaaatcgcgattgagttaattggggacgtgaagctcgtataagtattcttgataaactcatctttaacagaaaaataataatgaaaaactcttctgttttggatctgtctcacatattggagagatgctcacgttagcaaaaaatcacatgtcgagaagattaatctcaaattagtttcaccacaatgaagttgaggagatgctataaaaatatatcgaaaccgttaagtgaatatggatttatggaaaatggccagatacatcaagatcaaaccatccttctctaagagaccacttaggacctctaaagaaaacaaaattgataaggaaaggacaaaaaaaaaaaatccataaaagacaatctagatgataagtaactataaaaacaaaagttaatgtctctgtaaattaccaaaaacttaaactcataaacaaaaaccaatttagaattgaaacatgttaaccaagattgaactaaaaaaaaaaatcataataaaatagaatttcataagataagtcctacatttccaaaacctgatctcttcctctagttccaaaaccctaaatatcctttttgaatccctaaattaatttgtcaaaatgagttaattaaaatatagctaatttttaattaaagaaagagttgtgatgacagttcttacaaaaatagagattcatttggtaaaaattggatagaagatattttattagcatttccccttttgtttttcgttcaagtgaaggtttcaacaaaattaaagagaagatctcttaatcacaacaattaaagtaaagtttaaagactaaaaacaaagcctaaataaatatcagtttggtggtattaaactagcacgtgtcaaaaactaattggtagacaaaaaaaaaaagtctcacgtgtaacgcgaaagcctttctaaaaaaatttcttcagcatttaccaaactaaagcgcgcctctcgcttccttccttcaacctcttctttgctcatctctctctctctacaagaccaaacttatctttttttttctcttctctctgtctttttacacacagagctctgttttcaaagctctgttctgtttcttcgtgtaatctctgtttcttcaatctgttttttttcttctaattttgaattctcgtacagacgcaacggttatattgttgtttagcctctttgttcttcgaatccaatgtcttcgttgttttgtgtaaccatggattctcatctctag

SEQ ID NO: 4975 - DNA, 2000 bp, Arabidopsis thaliana
aaattaatactcgataaattaataacctctataaattaataaattctctcgatcccgaactgagactagtgtaaaaagtgacacaaaccgataaattaataagataataattttttgaaagtcttatgtaaatatatggtctcatcaatatcataaattaataattacataaatatataacctatatatataaatcatatgtaaggaatttctttgaaatattgtttttgtttaaatttgtatttattcttctttgaaatttagttctaatatttcactatatcaaaaacttttggtaattgttttctaaacatgatattattttttatttgtaattgattctagaaaaatattttttataatgaaaagaaaattatagaaaatttttaaaagttactaaattaggaaaatttattaatttatcgataaattaaaactttttaaattataaaaattttcagttccaacattattaatttatagaggttttactgtatatagattaattaaaaccagaacttgtattctttttttgtcggtcaagttaccgaaactgacttagagttaatttctatctaaatacaggtactcgagcttctctcagtttccacctaaacagctaaacagctaaatacaggtattcgagcttttctcagttctaacatatgcaactgaaacatgatcttgcgtaccaatgtgcaatgtctctatttagtatcagatacatcatactagcttccaagaatgaaatcaatcaatcattgtttgtaagcattttccatcataatttgataattacatatacataaatgacgtgtcgttcattgaatggttaccaatacacataatggtccatagaacagaggaagtgggtgcgaatataaatatacttaacatcaaaaacttatgaggaaatgataattacttttgtttcttacaaacttaaaaagagtccccaccacatagaaccacttggcctcagttacatgaagacgcaaccattatgttggaattccgactcattgctttcaaatctaatctttcataaatacaaaatttatattatttgtcttatggaatttaatttgacaattcagctttagacatgttgggtcctttctctatatagtcttgtctccactttgtcttcttctttttaattcgattgatctaaccctatgattccaaattgaaattttagttccatcttatttaatttcattctatgcttatcaaaatattaagaagaaatgcatgtttactttatcaaaaacatatttgatgataagaaattagatgtattggtagaaaacaaaaatttaccattctttttcaattcatatgttgtataaaaactgaattattatcatttgaatatattcattaggtttaatcatagcaattgatggtggcatgcaaaaatagacctaaaaattgggtccacacgtaaagttgaaggagtagataatttcttcttgctacaccatcatgtaaccaactatacaacatcacacatgctttgccacctcaccccacccatcccacctttaccctactgttttgaaacccggttttatttaaccaatccaatcggttagaccgaaattcaaaacaaaattaattgacagtaatttgtatgatcactgatactaaaaacaattatagccatttataattggaaaaaaaatctatataattttgttgtattgttaaaaaaatcaattcaataatccaccctctttttttcttccttttttggttaaaataacaatcctcggtctagttggtttgataccattaccaaatgatctggtttgtttcccactttcgttataaacctaaacaatgctacccccacttctttataacccaaacccatttaagaagtgtagtaagcttcttcacccacatagctataacaagagagagagatagacatagagcaaaaattagtttcttagaagttacaaaatcaaagatcagaaccaaagagcctaaag

SEQ ID NO: 4976 - DNA, 2000 bp, Arabidopsis thaliana
ttggtgttgctaaagagagaaaaattagcaaatgtagtcaaggtcaacctacaagaaaaggctatggatatgttccagctatagccaaccacatatatggtttatgcaaatcattgtaatcctatggtgggaaataaacacgcttattagctgatcaataaaataatagagattagaaaaagagtaaagaagtgataataaaagtgaaaaaagttttatattggctttaaaccgggcatgaaagttacagtccagttctatggatcctcgggtcaaagttttgcagttcaagatgtttggtgtttgcactacaaataaaataagagatcatcacttatcttacctaatcactaccatggttattcatttgtaatatataaaaaaaaaaactttttgcaattgtatttcatatgtttcacttttaaaatatgtatagaaacttatatattaaacagaaattataacatacaccggatcaagcagatagattttcctaatgataggagaaatttaggataagatagtaaaaccgaatgtctttcttttttctctttcagaacttttaaaactctccaccaatgttgagttatatgtcttatttctctcattttcttgtctatcagatacacgtaattcaaaatttagacgtttggtgaaaagtgaaagatctctcatatattgagtggcaacaatgtttatgatatcatcaaactttttgataacaatacaggaaacgttttcagaaaaaacaaaaaaccctgctatcaaacttggacttttggacttcggtttagatgtgtaatttgcggttcgcttgcggaaaaatgtttcctaaccgacggtactgtcctgtatcttcgacgaccgtgtatactcggtactaaaagaagaaaggaaaccggcgttatgatactcggtactagttagtgataatagtgctacaatcttacaaaactatccactggtaaagagaataatataggccacctgtcttgtggtgacgttaaaaggccgtaaactgtttcaaacaagtacataatttattgctaaagtcctgacgtggaatccaacgaacataattaaaagaaaaaaaagacttaagatcgatagcatgtctaaatttcctgaacacttggacgtatgttactggtctagtttaatatgtattactccaccaccaccaattgttgttaattttttattatgtttttaaccattataattaagggggctacatatagatataggcctctttgaacccatagatactgtacgtgtcacatatctaagttcaactttttttttgtgaatctctctgttgcgcaaaaagagttttggatttgatgctttagaaatcgttacccaatgcctttaaacatttcatttttaacccctacaataccctttttagaaaccaatgagaccctttttcatttaaaatttatattcatatgacacaaaacattttctttcttctaagaatatgacagcaaatattacctatttatttgttctgtcgtatatatgtattgattaaacaacttaaatttataggctgatatgatctagtagcctcttttatccacatagactgtatacccttaatatgttataggtttttcatccttgaagtggggttcttttgatacgatgatatgcttaaaaacatagactatatatctatctatatatatcaaataagaataatattttcatacaaaatataatatcattttcttttgatctccctcaccatctctcttaacataaaaacaaaacaaaaaagatagtgagggagaaaagtggtggacccaagaaagctttgtcagtgcatatataagaacataagacattaagacagagtagcacagagcttccataacaagacaaagccaaagagcaaaagagatcggtagatcttatagagagaacaaatttttcctcaaatcaaaatcagaagaagaatgagttggtggggagtgaaaggaggaggatgggga

SEQ ID NO: 4977 - DNA, 555 bp, Arabidopsis thaliana
caccacttcccaaacttcaatcgaacaaagatgacgaacactagtgagatcagaagctgtgaagaagctactaggcaacgaaattatatgttgtcaagagattttttacaagtaaaatatcttcaaaattggatccgtcaaaaatgacaggtgggttatttgactgtattcgagtgggttaattattaatgacgtgtaatccacgtggcagtttaaccgcatttgccgggtttgttcgaaaacttccgttttttattctttacccaaattgccctttaaaaaataacataaaaattggcttattattattttatttttccctcccatgataacagcatttgtcaaagtcgtctttcttttttccttgtcgagagttttgcttcttcatctaaaagatctatacatcttccccaagtagatatgtttcataagcctaacctaacattcttcccctcattcgcgtaggatctgttcttcccaaaacgactcatgccgtccattcgattcggaatatagttgtagaggagatttcatttctaatcaatttcttcggtg

SEQ ID NO: 4978 - DNA, 1709 bp, Arabidopsis thaliana
cactgtgtatctcagccgtctctaaatgtttctggaagctgcgaaatgtcctttaactgtaataatgtaatagtttaggggtctaaaacgaaattgcataataataataaaattttatctgaagaagcccacagtgacgagaggaggaaaatcgtaaatttgaggaagcttggaatcgtttgtttgctctggagaatgtggtgttccgattggggagacagccatggcttcgattttttcgatttcgaggattacaaggtaaacaaacaaaaaaacaaaaatttgataattgtttggttttgaatttgttaaagttttggtttttgtgaattgggtgttgcaggatcactataaagttctggaattgaactgtgacgcttctgatgatgagattcgttccagctttatccgtcttgctctggttccttctcttttccacttcattttcccactaatttgtgacagtctctgagtgtgagttcttcagtgatgattgtgttggagttgtgttgcagaaatggcatccggacaaatttaaagaagaggattctgctacgtctaggtttcaagaaatcaacgaggcttatcaaggttttgcttctctttcatcgtgtagatgtagttgtgtttgtttgttgagctaggctttgaagtagtagtaagcttagaatgtgaatttgtttcattggtcttcttctaactatgtaatgcagaatgtattattgaaggaaagaagtttactagtttaggggaaaggaatctgttttcatttagccattgattctgtggactttagcaataaagaatttgatcttgtaactgaacagtgttgagcgacccaattgcaaggcaggagtacgataagaaaaggatgcgtcgtatctatgagcacaacacggtagacgaaagttattaatttcattcgagagagaaactacttccaaagcttttgagtttgataaatccctgtgtatcttctgttgcaggaactattgaatgagtacaaggagctcatattgacttgcaatggccttggggtgaagcattatctttggtaattgcttaactaagattaggtgatatgtatagattatacgatgaattagcatatttagcagggttgagtttaggaacatcagcatttaagcagggttatgttttgagagcatcaattagaacgaatcaggttttagtttctctgcttccacaaaaaacattttgtcgtctccttagcaaccattatatcagttttcaactttatctgaacattgatgtcgaagataatcggtttcgtttgcattaccagaaaacttcatgttggaaagacagaattagtgtagttggtttaatccctaatgatgaatgaactgtgtcacaccacactactacaagcgagttctctaacccttgaaatgggtttgtaatcttcacccaagagaaaatctaactactctacataatctccgctgaaaaaacactaatgggcctaaaaacaaaattagatttgaattcggaatgcaaaagaaaaactaatgggcctaaaacccttgagagtttgctagaattggggggttttggaaaaatgtagaaaaagagaatccaagtgaaaaagaaatcagagcgagagaagaagagaagaaaggttctaggtcttgtttgctttcccctcctgctaatcgaccaagcgaataatctccagctaaccaccg

SEQ ID NO: 4979 - DNA, 2000 bp, Arabidopsis thaliana
ttacagagttatatgatattgttatactgatgagcatgcttacgagcgatgaagaatgatgatggagataataaaacaagaacatacaacttccaggttcattgaacctggttgcctttttgcgcacccacaaaggcgcttaaggagggattaaacaagagagtgggtcgaaatttatatatagacccgaaatttttaatttccctttcatttatttttaaaaaacaaaattcatgcaattacttttactaatcactactactattatgtattttctctcgtattgtattgtagattgttttttctttgtcagaataataatttaaaactaccgttaataatacatatggaaaaacgtaactacttttttcatgcgtagtagtactaactcaaatacgaagttccatacattagtcaggttatatactttttagtaccgtattattaaaagtaatagtagaaaagaaaaagaatcactttaaatagtaagaattgtggaaagatgacctacctacaatacaatcaagttcaatcaaatataactatacgaaatggacacgttgtttatttcattacacccaacttgtgttaggtcttttagttagtgcatgcttctcttttctatcttttccaaagattgatgtttccagttgttttagctagattgatgttactagttatctaagttgtgtataattcttttcttacttaattcgatccattggactttataatgtcaatctgtaacacaaataagacttaatgatttttgtttttttaaaacaaaaagttagcagtagtagtagtatctagattttctaaaaaaattctgtgttaagatttgatttaaataaaaattaaatttatcgttggatttctcgattaaaagtttgaaattcaacaagaaatatgttatgcattagcgtctatgacgacgacaaaaaaaatcaaaaaataaaaaaaatatatatgtcaaatgaaatcaaatataacagtaaaagtaacacttaagccgacaaagcttcgtgtaaaaaagtagattacagtgtctgttcaaacccagtttatcacgtgcccaccaaaccttacaatttgcaactcaattggcttcttcggattctctctttttcttttttgttgatctctttgaatttcagcaaaataagtagattagaattttgatttaccttagaaataattttattatatttctcaatattggaattccaacggtggctccgtttttataatttactaaatttaataaagtatcctctctagaaagtatgtaggtttattttcactactaatctttaaaaagattgcatctatttcatattgtaacttttgagaaatatatttttattattttcttaaaaaaagttaaacatgtttttttcttaaaatctttttatgtcacagaattttttaaacataaacttctttctatttatcgtcaattgattttgagttgaaaataattcatattgagtattcataatttctaaacgttttgatataaagatccttttataaaccgaattagagaaaccctgtaaatcttcttcattgcacaaaataagcagatccaagaattcaatctagatcacttatcactcgatttcagtgtctacgtatcctctatttcaaatttccaaacacttgttctactcttacatctccgtataacaacactactggtaaaccaacacaaaacaaaaaaaaatctactcgtttgacccaaaaaaatatatttgggccctaaagttcaataacaaaatcgatgctgacattattgtatgtaacaaggcccatagacaataattcaaaaatactcgcaaagagattagtgttgtgttgaattgaatcacatccacatacacccaaaaaaagccaaatcacgactctgtttactcattattatcttcctctctatcatcaatggctccaatcgtaccacttcaccgtagtactccaaaatctccacttctcacgaaaca

SEQ ID NO: 4980 - DNA, 1134 bp, Arabidopsis thaliana
gacttgggttcagttaaaaatctcaaattggagacattattggtgtttatatatttgagagagagagccagagaggagacgttgaattgaatgaagggtgtggtcggaagagaagacgtgtagaagagacgagacaagtaaatttaagcattggccccatttacagccacaagtccgctacaacaaattatttccaagaaactctgagataacgtcgtgatgaaacggctcatgctgctgttgtgattcgtgaattagaggtttatcttttgggtttttgaatgttacttaattggacggtcgatttttcaaactgggtgtgaaatgtgaatgggtcattcataatgggcttttgttttaatgtgaagccattcacacactctttgtccttcttttctattattcataactgtcactctttgttcttcgaaatagtaaagagcaaatcgattctttgttgatctgggccgtaaaatttccatggttgtgggaagtattctcgcagctgatctgggccgtcaatgctacagtttcatgtcagagagaggtcaagaatcaacacgtggccaaccatgattttaaaccaaagcaaacacacgattagaccccacattgtttgttcaccaacccccgtggaccctcctttagccgacgtgtccacgtcaatagtggtttttcttcctttcaaagtacacaaattccattctttctcattttactttttggattacgttgttgttataaactggtaaaatgaattatgaatgcaaataaatttcatttaagttttgttggcttctaatatttttttcacctaaaattctaataaactacacagccatgagccatcgtatgaaaagaagaagaaaaaaaatgtctttttctagaaggatctttcaacgactaaaaaagattttaagcttttgactaattttgtcaataatatacacaaatttacactcaattatagccatcaaatgtgtgctatgcagaaacaccaattatttcatcacacatacgcatacgttacgtttccaactttctctatatatatatatagtaatacacacacataaacagcaaaagcgtgaaagcagcagatcaagataagaaagaagaaagaatcatcaaaaa

SEQ ID NO: 4981 - DNA, 2000 bp, Arabidopsis thaliana
ttgatcttctctttttcttgatactgttttcgctacaagtgacgtgtttatgttagaggagagtacatgtgactctgagagtgtatgtattttattatataaatgaaagcagtcacagtttaaaggaaaagtaaagcagtggaggctccggtgtcgtctcttttgctctgctttgaaagcggtttcaacgagataatcagagcaagaagacaactggtgctctgctttctcgccacgtagtttctagagaaaaaaatgatttttgattttttgcatgatttcatgaaaaggaatgaataaccgatcaaataatatttttaattcctaaacagatgtgtgaatcaaaattttgatggatctcttctgagttacttttaatatgtttgggcctacgtgaaccttattgggcctctaatctatataaattacttttattgtatctaaagagaaaaaatcagaatatgttttggtcttttgggcctttttggtaagctgagcacaattgtgcattttagtaatttaggagattcgctcggatctacattgaattgttcggaagaaagaagaaggaattgtttggatctttgggaatgttaaaacaggctatttgggcccaatctagcccagtccaacacatcgaagcacacaagttgctaaattggtccgattagtcttagagcttgattggttctccctctgtcacccgcaaacgctgcgtttgcgggtggtagcagttgttagcgtttgacaccaatcataaaaaccgttagataccgctttggaccgctcgaaatcgccatattttaaaagttccttcccgcaagcgtttgcggttgcgggcggtagcggttaggttaatttttttttttaattaactaaaataattatgtcttccacccaaaccctatatatcttattcttatcagaaaatcctaatcaatatattgaaaccctattctctcaattatggcatctacccaaactaacgaaaatcaaaatcaaaatcaagaatcaaacgtaagtatgatctatcctttcatccattcattagctagtgtaattctctgagtattttatggcatcgtcattttatttattttgtatttttttgagttttttgattgaatacatgttttgatttgttttctcgattagaaaattatttggtcagacgagatgacccgtttcttgttagaactttatcatatgtatagaggcaatccggaaaacccacgagttcaacgttatttacagtttattacactacttgatgcaatttttggtgatgtaccaaatgcataaagtactaagctttttcttacaaaatttatttatttttgaatttaatgttttatttatggttttaattattaagcatgtttaatttttctaatattatcaatttatcataataatatattgtatttttttcttttactagtaatatattatatttattttggttattttttatttaattactatcgcacccgctggtttaccaatcataaaactcccgcaaacgcactcattatcaaacgctcaaccagtcgttcaaaacacttgataacgcttgaaaccgcaaccgcctgtttccgcaaactcccgcaaccgcaaccgcatccgctgcgtttaaaccagtcaggcccttatttgttagagacatccgaacttttaaaagttaaaactgatatgcttgtccatccataatgttagaaccgtctttggaattggtaatccacacactataatgcgactcacgtcgggacaataacactattgtctaccgtgcatacacgttgttcttatttcaagttttgtttggttttactattacaagttgctcgttttcttattagttaatgtacactaaaccaaataatttaattagaaaattaaccttctttttcaacgcaattaatctataaaacccaatagttagttttcaaaaaacttcacttgcttaagcaacatataaacaaagcaagcaaaaaaaaaaa

SEQ ID NO: 4982 - DNA, 2000 bp, Arabidopsis thaliana
gtgattttcggcacattaaaattctcttaaattcgttattctttttcttttgtaaaataaaaccgcacatccatatgctaaaaacagattccacgaacatgaatattcattctgattttcttcttcttatttttttgcaattcggatgataaaacataatggatgatgtattaaagtcaaagattttatatagtgggttggttgtcgccttaggattagagtgactatgtaaaaaaaataaaaaaaataagtcaatgatactgcgactaagttcaatgaaagatcaatgagctttttattcagttattttttcttattattatttgtggtcctaattaaattttaaaatatactttttattgttttaatccttttcaattcaccaaaggtccatcattcacattgtcaacaaaagatttattgaaaagttataccacaagacttcgtaaaaatgaccaactttcctatatataaaaaaatagaatcagaatcattaatacaaattaagtacacacgcatatatatatgacatatacatatatataagagacaaatttgagctacacaaaatatctacaaatttataatatggaagccgtgattttttttttaatttataaaaatattaatttatacagcgatttgataaattttttaatttttaaaacttttctaaccaaaatcgttataatcaatatatttttaagacttattaaaagtaaaaaagaataattctgtctaaaaacataatattgttttgatgaaataaaaatattagaaatgaactctaacaataactacgacaaatttaagaaaaaccaacaataatatatagtcatatttcactaaagttaacacaattgttaatttataatatcgatgaaagtatgtatttatataacaatattctaaaaaaagtattatcttattaatttatcgaatcgtattaaatgttaaaatagcataactcagactagaattttttttttatttacagtaaaatgaatattaatttatcaaatatcaatctataaaagttatactgtataaatcatccatcacaaataaatattagtctcaacttcatttaacaggtttctaacctctccatcatattttttttttaataattcacactcacaatatatcaacacatacttataataattttgagcttctttttttctttttaaatatacaaattataatttttacttcatctactgagatctgaacctattatatatttgacgcaagtatcgaaaagttttttagaaaacactcattgtttcttatggctgattgttttttgtttacgtatatccatatatataggccttagcgttgaaccccgatagatcgtagagactacaagtaaatgttgatacccaattttttgcacgtataatataagaattattttccaattaaaccttactatttacagatgagtctagaattctctatctatttttaaaaaaatgattacgaccacaactaatatacaaacaagattcatttctttctttattttatttttatttttcaattacgacgtaaaggatgatccatgaactatattgtttgtattagagaatccaatcaaaccaatctctttggattaatatcaaattattttatccccgtatcttttacagtttcaatttagatgacgatttaagaagctgcaggcgtagcaattattttaataattacaaataaaattgagtgaaaactgtcaacagtctacttatgtgtaaaactaaataaatgaataaatcctcgaaatttaaaaataatgaagaagtcagcatcttcataatggattattataaatatacacatagatggatgttcagacttcattgagatctaagatcacttgaacacttataaaaaatattttgctcttctttctatatatttatataaaaagtcaaaatatcaagaagaggaagaagaagaagaaactcattttctccgcagagaaaatacaatcc

SEQ ID NO: 4983 - DNA, 2000 bp, Arabidopsis thaliana
ttatgtatgttatttttatgaatgggaaatccttatatatcttatatatagtttaaaaatttagttgttgtaagtttttaaatttaatgaaaataaaacaaaagaaaaatagaaaaaaatatgtataatttaatattaaagaaaaccatttaaaaagtaggtaaaaaaactaaagctatactaatgtttattgttttaacaagcataactggtttttcttcaattattcgccttagaaaccgttttggggaaatcaaaagcaaaacatgaatctaatattgtttcaactacaaccgagtatgtaacgtaatccaccaataaagaatattaaataaattaacaaaatgatctaaattacaaataagttcatacacattatgacccaaacaatgatgttgtgaacatatattcgatatcgaatataaaagaacataattaagactaaaatgtgtaagaaatttaaaacaaaaaatgaaagaattgacctaaatcgtagggctttgaagactcatatcctgaacttattcatcacctagacaacctacttcttttttttacagccaactcttccccttcataccaacgcaatatcttactcatcatcgtgtaatatggtcatatattcactactcccaacactgcaacacatggtatctaataggctataagcagtttgaaaaccatgtggatgaaaaacctttcaaccacaaaataaaataaccaaaggtgatataaacatcaaatttaattgtaaatatacattcaaaatcaaaaataaaacaatttgtgtagtatgatgtgacataagtaaaatgtttactatttactatttataatagaagaaggtggagtaattaattttgtaaattaaacatgcttgtacacactaatttagagtaaatgcaattaccaaaattaaggatttaaagggttttagtcatttatatgcatcatagttgggtaatacaaaccaaattgaacaatagaaacgtccactaatttattattgataattaatagcataagtttcaactgagccaaaaagtaaaaagtaaaacggttattaaataaaagtattggacatcaatcttataatgtgtatgtttaaatgatgaattttgtagtcaaataagtttcgtatatctttatttttttcttttaattatattaagaaaataaagatctaaataataaaaaatgtatcaaaataatgaaaatatttttgcccaaaaaaataataatgaaaaatataattgtgtaaattgtctttgttaaagtcaatgcatttaaatttattaattgttataaataaatagattggactaaaatttaaaaagtgacaaatgtcgaaagaattattttgtaatcacacagctttatatattttattttttgctttaaataatattagcaaaataaatatctatataatgaaaaatgttttgcccaaaaactaagaataatgtatacgatgtaaattgtcttattaaaatcaatgcatttaaatttattaattgcgataataaatagattggactaaaaattttaaaatgacaaatgtcgaaagaatagaatgccaagtaaccatttatcagagataattttggagaaaccttactttattatataagataagattcacatatttagcaaaaagaaagaaagaagaaaaaagtaaacacaatacaagatattgagatatcatcatcacaaagaatccaattaaaaatcagtgtcacttattacaaaccacaagatcttcaactgccagatggcaccaccacagccactaccaatcttctattaggaccaaggaaatcttcgaaatctcgattaaactctctcaaccaatcagaattcactgacatgtacatttgataaccctctaacatgaacgccttctctgttataaaaccatattggtttcaccatctcatccataactcacactctctcttatctcctttcctttcattgtagttaacgaaaagattacgata

SEQ ID NO: 4984 - DNA, 2000 bp, Arabidopsis thaliana
gttagtaatgcatcactataattcattctttttttgtcttggtcaaacatgtatgaagcgagcagagtctatgaatgtcatattatagacatacgtatgcggctttggtcgggaccggcccaataaaacaatacacatgttcaacgggttcttccacgtgtcaaacttatgttggctggacggtatgtgactgtgcattgtggttacgtttccaaaatgaatacgtaagaacttttcctaaattatgtcttttgcacaatactgtaagtctgtaactatggtactaaacattataatatcgaattggaaacatttacatttgagaattttagtgtttgttggcaacgaagcatgtgagatcacagagaagcaatactcatctctgagctgttcaaacagttttacatgtcagcacccaaatatagtcactatattcaaaaacaaaattatttacttgcattcaatgctagccttttttattcggtccacaacaaattataaatatttgtatataagaaaaatcagagacctgattttgtaatgcgtggcttgtcaatttcaagcaacacagaaaaaagctaactaagcaaaaaacaaaaaaaaataacaagtggctggttgatagaatgtatctttcatcagtacataacactgtttttttgtcaacgtaaaacagatttttataacttttgtttgccctcaacttttttcattacattttctggaatatcgcatggttgaataattaaaagttaaaaatgatttttatgaagcacggcattatactatatagtcagtcccaacgaaaatgactttacataaagctgtcaattttttctccaacggtcagataattgtttcgttgaatagtcagttttttttttactattttactattgggctttattgggctcttacaattttatcgatttttgtttaccgtccagaaagtggaccctgtgggaagaggaaaagaaaaaaaaagggtcaggttttttgtctttatacgagagcacatcggtacgttccagaacaaccctctctagtctcctccatcattatctttatttaatagtaaccctagtacaaattaccaaactattcaacattaacataattattcaacattcaccatcatgaataataactagttgagaaaaacgtaactagactagtttgatctgtcaacataaaaagagaaaaaagaatttcgtgactagtaaagtttaagaccattcacaaatgatcattgaaattattagttctaaactcttagtttggttatctatttggttttgattcgtatctatttggttattcggttttttggttttaaagtttagtattcattcgactattttgaaattttggttcgtttttttttttttttttgaaatttaatatccattcgattattttgcttttaatatttttaaatatttcaattattttttgatattttttgaatattgttactatttaatatatatttttaaatatttttaattactaagtatagaaataactaatatttttgaaaataaaattatattttggatattttagatcatctaaaatattttagttaggtactaattcatttttggttattttgattataaaatttaatatctattcaacaatttttaaattgttgattcaattcggttctgtttttttttttcatttaggtttagtacatttggttcagtttatttgactctcagtttatttgcctaagccttgaaattaggtgttaactattggttattctagttgaaatttgaaataaagaaaaaactatacgttatactattttattttcttagcaataactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaa

SEQ ID NO: 4985 - DNA, 953 bp, Arabidopsis thaliana
aatcatttataaaaagctagtttgaccaaaaaaaaaagatcccactgattttgccaataccaaattttactattcccaattaactgtaccaagcaatatctttttggtttgtaacataattttggcaaagtttcgacatgtatcaaactatcaatcaaatttgcgatactgatttctatatatagtttcaattttatttggatatcacaaataaaaactaaaagtgggttgaagaatttacgaaataattaacataattttggtcggcgctgaccataataattaataaattgcgtcttttagctcttaagtatagtcaaacgttaattttttttagtaaagcaaaagacgtgtcaaagtcaaactaactaaaattagatgttctcatatactgatatacaatcatatttttaattatgaaactatattgcgtcgttgacaaaaaaaaaaacttagattgcatcaataatggttattcttacaaaaaaaaacccgttaataaatgatataaaacaaatgaaaaattaaaaaattcgatatcataaattcatgatattctcttttactcttttagtaattagatctccgaataataaataatcgtttactaaaaacgtcctccacaaaattcggcaagtaaaagaccaaaaccaaatctcttcagggtcaatttcgtaacttcacactaattccataaccatacataaaaacaaacaaaaaaacaaatcctgcgagaaaaatcccaaaaaatcaataatttaaatcactttccatagtttacagacaacacagagcttgcttacgtgttctccaaattttgtatacattattttcacaaaaccagttcctcaacaactagatccatcatctctagcgttcttaaagtttccaacttttttttttattaatttgggccaactttttttggtttgagaattgggcgagggagaaag

SEQ ID NO: 4986 - DNA, 1640 bp, Arabidopsis thaliana
tttcgatggctgtgtcgagtttggaaatcaagagttattatatacggatgaccaaaatcggaatcgagtatactcgatattgaaatgcttgatttttagtcacggctcggtactgttcggtaaaaagcactggtaagtagtgattattaacaaacgcaaatggcaatatcgttttcgttaaatagttttgtctttccgcgctatagttttggtcacggctcgtttgattggtaacaatctaacaattgctcccacctattactctattagtatacgtcctattgctattattttgtgttgtttggaaaaatatttatagttaaatagtagtagtagtttttatttatgaatttgataaacgtggaacatatggttgagttgaccgattagttcttttcttttttgaatgcatatgttgactggttctaattattagtactgtttactttggagttttgaatattgataacaaatatattttataagcattgatttactgtcacggccaaagctacttatgattgatttcaaataccgtctaaatgttattgtccataaacatgagaacaagatcaagtgatcacctgtaaaagtggcatttttcaaaatttctcttaattttttatttttctttctttcttatatatatagtaagactactacaagataaaatttgaaatacatataaaccagtaaatcacaaggttattggtttctactagacatatctatctatcttaatcatattatcaatccatatagatcaaatgcctcactaattattggtttgtactagagatatctatcttaacgtaacctatataacatgtgtatgaatggtggattatgaaaagactaatctttttttttattatatcaaaatccttagagatgcgacaaaacacaaaagccaatccatgacacattattgtgttttaaacttttaataacacatgttcttgttcaataagaaaccaaaaaaaaatatattttattttgagaaagttagtatttgtgaggaaggaacaataaaagagagagagagtggtggtgagtctgattgtgaccgtgtgactgtcttttacaaattgggttatcacctgactccacaatagagagaacccaaaaaccaaaaaaaaagagtctctctttgctctcaccacactaagaaagaagaagcgagggagaaggagactttttgactcttctgcttcttctcctttctctctgtcacttatttcccctctttgcttccgtcgattcatcccaatctgatcatctctttctccggttaaggtctcaggtttgtgtttcccctttctaattaaagcttcatcctttttgggtttcacctgatttcatttgctagggtttacttatcagctcttcaatttctagggttcttaatttcgttgcattttttgttctcgatcgtttgttttgcccttttatcaaatcgaatttgtcttgctgtaagttttagggattagtgagagtctttaattccttaaattggaaaaatttggagatgaattgataaagttttaagctttcttgatttggaaaaaatgacatgtttgcgtttgtgagtgatttagttgtttgatgaaatctcaggacttctcagattcgaattataa

SEQ ID NO: 4987 - DNA, 2000 bp, Arabidopsis thaliana
atgatttctttgttaaaatttgagtttaaatttaatagtatatatgtgtgtaagttgaagaaaacaaattataaagatcatacatatgacaagaaaagagttagatagagtgatttttaatgaaactaaaataataagtatcctttgttggaccccaaaggtcagcaagtgagcttcaccacaagtattatattccaaagaaaagcattcccctcacacgaatctaaatataatcttatgcaaaagtagccaccaacaccaaaatatcataatcaaacttttgggagacttatgaattactatttcatggaattattaacatatagagcatgcatacggaccatataaaataaatttaaaagtagtttcaccactagttgtgcatgtttaaagggtttaagtggttctcataaaagatccaaatcttgtttccttttacattttgcaagtgtgcctttatcctcatgcatcattatatacaagctttgttataatctcagaaggttacatcttacaataataatattaaaaaaatcgagcaaactcaagtgaagtgttacgtatagtatacactatactaacaagtcgctttatattcattttaaaatcaaaatcccagcaattcttatgatagttttcttagattatattattactcgcatattattcgattaacatatgtgaagctttattttgcaaaatgataagctatctagctacctcaatatatattcgatttgtaatatattgttatctcaaattcttggtcgtctgagttacgtatgcttttaattttagctacccgaatatttaaaaaattaaatacatgaatgtataatatacacatctattttattttatttttacgacaacaaaatcacatattaaaatacgtatatatgaaatacttgagtcttgatcaatgacagttttgttttgtttttaaagggtacaatgacagtttcaacatctagtgtttttgttagttaaaagttttaacatagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 4988 - DNA, 2000 bp, Arabidopsis thaliana
agtaaaagaatttgaataaagaagagagacgtggtcggacttggcccaccaactttgtcatctatgatgcaaaatatttaacaaataacaactaattgaggttgtaacgtgcatttgtaatgcaatacattgagaaaaaaacaaatattatacataacaaagttgagtttttttcactagttgtttatttaagaattagaacaatagtccactgttttttaacaagtccatagcgaatgttggaaacttattttaaaaaattattaattggaagtctaaagaattacgaaaacaaattgtatttgattaaaacaaagtacaaattgcatttaaaaagaaatagtctatagaacatggatgatccttccatataaagtttgatcatgcacatagtatgacaataatcaaagagcggggatagctgtgaatctttagcagcgaaaacttcaaacatatatttcatgaatacaacaatgttataaaatgaatttcgtacgacataataaatgttatagtaattcttatgtttgtccaaaaaaaagaaagtaattcttaggttaaatatataaaaacatgacaaaagtgtaactattaaagatatttgatgtactacatatatataacaaattttatcaaagatgtacatagacaactatgttcttaaaactccacaaacattacggcagttagaatttaaatttatcttggaatattgtttgtatattattaacaaatgtaaattggtgtaggttttcagattttcataatgaaaacagttttaaattatggttacgagataattttgacgaatatgaatacatatatagaaaatgtttgggcctatatctatgaaaatgtttgggcctatctatatctatgaaaattgtatgagataccaacaaaataaaatatttaaagtagcaaaacattgtgttacttttctattatcttgtcttaaataaataaaaatcaattttttttttaagaagtaacacaatgtgaagaatacgtgtgtacttttttttttttggcgtaaataaaattagtaaattaagacaagattaatagaaaagtacacacgtattcttcccattgtacgttaaaaagctcgtgaattcacatgcatgaggacgatttgggtaaccaataagttgactatatttttgtatgtctttctatttttcttcacatggaaagaattttccaacgaaaagttgaaggggagacaattaggaacactaaattgtcaccattaggctcttaagttttaatttggcaaccaatttcattttctctattctgtatttttggattgggaccgttttatttgtttgtgtgtgtgcaacttgagctcttcttctgtaacacgcatgtgttgcgtttggtttttaatttatttgcctacttttgcgttttcaacgtttgttaccacatttgaactataaagtccaattccataccgatcctctacaaccatataaatgtgctacaacaaaagttaatctttgatcttgatcaactcaaagatgactatacatgattagttctcctaaaagctaatgttgtagagtgcaattgccgacaaacctccaagttttgtgtcaacttgaatttgtacttaattgcaatctttggaacgtgttcattcgaaaacgagaataaaaagaaaaaaacatgactacgtctataacaagtaaacaaaagacaacagtgaaaagaatcttatcaaaagttcaaaacgcaaacgtggctaaacctgtacccaaacagtcccataagaagccagaatcaaagtacactgtgtatataaatgagcccaacaataaccgaataaacaaaaacaaaaaaataacgttgccttgacgtgtcatcttactccatcccttccttttgcttcttctcctttacttccttttttttttctttccatcattttgtcacaaaccggaaaaaaaatctcaccggagaaaaaataaatctcaccgacgacgaattcgatc

SEQ ID NO: 4989 - DNA, 605 bp, Arabidopsis thaliana
gtggacgacttttatattcttttgatttttttttaaataattttttttttggtcagatgtcttgtgaattttaaaagacaataatcaacatgtagatgattattccattatatgtgttgttgatgtattaagtcatttatcgatgagaaaactaactggattttgatttagtctgtttatcgttacaaagttcggtttattatacagatttaactgttatgtaaaatttaacattgttatgtaaaatttaacatttaaaaccttcaagatgcaaaaatctagtaaatgcaactatattaaacaagactttattaattaaaaaaataatgaagaaaattacaatcagaacttcttccctcaggtttaatcccatggtccaatcaaagttatacaaatatcaaaaagatcccaaagaaaacaacaacaaagaggacgaaatgtattagggaaaaacagagagatctctcaaacaaatcatgataagaaaaaacaaaggagagtgagagagagagaatgatagagtaatacgcaaggcactctttaagccaaaacggcgtacaaggctccggcaatgactgtgctaacaaggaaagctttgttagtca

SEQ ID NO: 4990 - DNA, 794 bp, Arabidopsis thaliana
gacaagaacaacgtgagattagttgttgttgctctgtaatgttgattgctaattttagaatcattctttgtggattttggacaaaagtaaaggatggcgttgaaccacacctctgcttccgtaccagacagttaacattataacactttaaagagatgtttctatggcgcaggaatcaattagggtaaaaagattaattgatttttgttgttagataaatttcatgtgacatgtatctatatttgaactgaaactgaaagtcatcctaactaacttattcatagtattttacatttttactatctttctttttttgttgccaacagattcaattttagtttgactactactactagtaatatccaaaaaaaaacgaatcttcaaatcaaactctaattggtgattagagtggaaagaaaagaggaattgaatttacgtatgtacaaaaaagaagaaaatatccatcaatgcgcttagtattaaaaaaaactttcacaattatggcaaaaaaaacactttcacattcggaccaaaacgacgacgtaacataaatgtatcgttttgcataaaagcagtaaaagtgagagagagagagagacagataggaatctttgagcgattcgtcttcctcctctatcgccctctactcttcaccggaactgtgatctcaccggaatatccctcctttatttatcctctactcatccgttttactctctccctccgtcgatcttctctttctcttgatcgcctccgtccattctttatcatttcttaattcagaattgtgatcg

SEQ ID NO: 4991 - DNA, 391 bp, Arabidopsis thaliana
tgttgtcgtacgcggagcactgtctctcttcctctacacacagagtctagtccagtctctggtatttctaatactgccaatcacatccttcctctctacgcttttaggggggttttaggggagcgtcgatcaggtgcgacgagcgtacgtttagctcgctcgttgatctctcaagtctaataagttgactaggtttgactagtcaaaatgtgtgcgggtgtatacacacactggagagcttgccgcgaattacctaggtcccactaaggaaaggacatatatatatcatgggcaaaaaagtgccgccaatcaaaacacttgaaaaaaagcaggaaaaaaacttacaaatagaaccggcccactcatagcccagtaataaaaaagtccatta

SEQ ID NO: 4992 - DNA, 2000 bp, Arabidopsis thaliana
ggtagagggagaaccaatcaagacctaactctctcccacaacttgacacatcagcacatgagagcttgccacctagacttcataaaataagtaatacataattagtaattaattcaacataacaactaaaataggagaatataattaatgaaaacttgaaccatcactctttctacattttttaattcaatatatcctctttaattttgagatccacttaagtggttaaagtggtgataaaatccaaacatgttacacatattcctggcctaaaaattaaaaattagacgattattatgaaaaaaactaaatgaatatgcagattgaatatatctaagcttttcgagatttatgttaagaaaacaagtaattagaaagatatttgaggagctatccttataactaatacgtaagatataagattatgacaaaaacttaactaaactttccaagaacataaaattgaatatgcttagattgaatatgaagagacatgattaataaagacaagttatatttttagtgtaagaaataaattttctaaaatttcaccgtctcacaatctatacatataactaaaaaagcaaggacatataaattcaaaaaaaaaactgagaatctaaaacaacaataaaaaacaactcaagcacattcgtttttcagatgaactaatacagttgggtttttctaaaacaattacaaatcatatttatgtttcaaaacctatgcattcaactttactttatatgaacagacattatataaaacaatttgtaaatagtaatacgtaaacaaatgtagcgtttcttggatgagggaaaatgttgaaaaaattgaaagtattaaaaataatttgggccctgagccactttttttaaaagtaccagtcttattctatacattgaaaaaaacaaaacttagaatttgggccttatttagaaaccgggcctgaattgtttcttaattgttgaatcaaataaattaacttgatacatgttttatgatcgatcggtagataaaacacaaagttcattgctaaattgggagaaaagaaattgcattatcaagggtgttgttcaaggattatcctatctgcatacttacgcagcagatagttattggtaagagaaatgtcgagcttgaaaacaaaatatatatatatatatatatatatgtatgaaatagtatctaggatcttaaattagaaaatcatgtaacatcagtgagtgttgttctttccacggaagaagcagatattgatgcatgagatatatcctaaagatgtccaaaaggttttaggccacttttcatccattctcagtaggtaactctgtttaggccacttgactcagattagtgatcccaaggtactagtttctgaatttgtttgaacaaccaattgtctttagaaagacataaactcttgttccaataaagagcctataccaactctagctattcaatgacactattttagggtttagcatttttgcattattgtccaatgatacaaaagagagagatggatatatgaatgtcctctctatcttgacgcaagcacacaacagctgaaatatcatatagacaaggacgttttaagaatctggtggaattgatttgatagtagtatacaattgtgatgtatatatacatacaaatattaactgttcttggatttattgaaaggaaatgactttaaattacaagaagcgtgacccacacgttaagtcagtctttctttactaatattcttttcgattagtcaaataaacctcatgaacaagtcattggagcccacttaaactctacttttctattcttcttctttctttttgttattctatatattagttagcaacttccacgttgtagcgatggaaggatccaagctacttccttgcgtccataagtctccggttcccacctcccaccaattatatataaattatgagattttgggtttaacaaaactcaaaaaacacaaatacacccaaaacaag

SEQ ID NO: 4993 - DNA, 215 bp, Arabidopsis thaliana
gaatcccccatccaaagtgccattcttataagtttcgatcaaaacccaattttaacctattgtcctgatatatcgtactttgcttggtctgcagggtttgcgcatgtatgcaggtacgagcagtgatgatatcatatcaacccattccaatctctccttacttaaatcctacacttacggtaatatctataatacttttgtagacacaacacaag

SEQ ID NO: 4994 - DNA, 2000 bp, Arabidopsis thaliana
gttatgaaatctaaaattaggaattaaattgataaacaataagattagtaaacttatttgtttgatgtataagtaagtgtaggcgctgaaatgcaaaaaaaaaaaaaagaagttatttttgggagtcaagtttaaagttttgaagttatttttctagtacaaaaaaaattcatatttgaaaataaagagtaattttgaagatgtcctaactcgttttggctctttttctcgattataatcatatatatgaagttggccaactctctccatatgaatgacacatcatcacacaagaaaaatgacatgtgtcattttatattttttaaattaaaaattaaataagcaacttaattgtatcatcaatcctactcttaattgattttttctaaataaaaataaataaataaataaaaaattatgttaaaaattaagcactacttttattatactctttttattttaataattttttattatcaataattactactctataatgactaaaattatagtctttatagtactaattgcccaactttcatatatataattttattttgagtctttgatgacattgacattcaagtttgttcaaatattaaacctttaagacattagagctaccaaataatttaatacacgatcatttcttttatatggatatatatatgcaatgatagaagatctaaaagtattgatttaaataatattttaacttttgctttctttttattcttttcatatgaatactcttgaaatcttattagtttatatcaattctatacatttaatcatgagtgtataacaatgttgttggaatactatattagaagaatacataaaaaaaaaaatagtttatatatatatatatatatattcaagttagaccgttttcaaatcatccaagacacgatcatatttctaatgatagaatattcaaaagtgttgacttaaatgacattcaatttttgctatatttttatttcttcatttgaatactcttgagatcttgttcagttgatgtcaattcaaactttaatcataagtctatcacaatttgttgcagtacataaaacaaggaattaatttatttataatcgagttagacaaattttaaaccatacaattaacatagttacacataaattgtatcaaaatatcatatattgttgttatatgtatttatgatagtgaaaaaatattaaatcttataaataatcagctttatacatgaaaatatataaattgatattttgagttacaaatgaattcaaccataaaaattgtaattacatattatagatctaattttattaacaatacaataataaataaagaataaacataaattagcaaaaaaataaaactcatctaattttttaaaaagttaaaccaaatcaattttagttttactatctctttattcagtttgataataatccttttttatccttttttcatgagactaatttttgataacaatcagtcagcttaacattgaaagtccgagcataaatggctaatgggataatcatggaaaaaaatttaaaaaagttaaatcaaatcaaatttatttactaggtttagttaggtttgtaggattaagattttgggactaaaatatagtttaacacccctaattataacgtttacaacattatttaaggtttgatacaagaaaaagagagatgtgagggtgtttagttaggtgagaaactctggaccgaccaagtggtcgattcaagtctgtgcaaagccgacaaaaggggcaaatctgtcattcactctgttttcaacctgagattcaccagaaacaaaaacatacggcggagtaaaaaacaaaggcgacggagataccaagaaaaaaaaaatacagaggaggaaaagaagcacattgtcgccgtctctttaacttccttcatcaatctccgtctcgtgaatctctgtttctttgatctgtaattgcgaattcgtcgtttcccaattttgaaattgttgta

SEQ ID NO: 4995 - DNA, 2000 bp, Arabidopsis thaliana
ctcattagctaattgattgattgtagtaatatagagaatcttcagcaaaccaaactttagttatttacggaccacatgataattatcatatctatgaatgtttttaatttatatattcttgctacaacatccgtttcaaaaattatagcctcaaaataaacaagaaaaacttcacagtttatctaccatcttcgtgtataaaaacaaagaaatgaagtagaaaaccctagaatctacactcacataatggtccacaaggaccacaacgaatgaaaacaattgaacacaaattatagtaaagaatcatggaatctatggaaaattatcagaccctacattaagacacaactattttctttataaaccttatgaatttttgtagatacagaacttgattcattgtatataattatgctatttccctcaattatccatatgcataatgcaatgcaaatgggtaagtagtcagttaaactaagggcttgattggttctccctctgccacccgcaaacgcagcgtttgcgggtggtagcggttgttagcgattggcaccaatcatataaaccgctagatatcgctttggaccgctcgaaatcgccagatttcaaaagctccttcccgcaagcgtttgcggttgcgggcggtagcggttaggttaaaaaaaaaattatttttataattaattaaaataattatattttccacccaaaccctatatatcttattcttattagaaaactctaataattaatatattgtaactctattctctcaattatggcatccacccaaacggataaaaattaaaatcaaaatcaataatcaaaagtaagtatcatatattcgttcatccattcacgaccagtttgatttttttttgagttggagatgtgttataaatcgtttggatatcttgaagaaactttattatatgtatagaggcaatctggaaaatccgcgagttcaacgttatttacagtttatcacactatttgatgtaatttttggtgatgtaccaaatgcataaagtattaagctttttcttgcaaaatttatttatttttgaatttaatgttttatttacggttttaatttttaattatatttaatttttctaatattatgaatttatcataataatatattatatttttctttcttttaatagtaatatattatatttattttggtttatttttgtttaattactatcacacccgctggtttaccagtcataaaactcccgcaaacgcacccattatcaaacgttcaaccagtcgttcaaaacgtttgataacgcttgaaactgcaaccgccagtttccgcaaacttccgcaaccataaccgcacccgctgcattttaatccgtcaggccctaaaaaaattaatcactaggccgttaatccctatccgtaatacgaaacactagagggatagaatagtaaatcgcatcgtgaccggtcataaaaagacacgtgtcgtcatcgctatccaaataattgacaaactcgaagccgccaagggattgccgaagacacatgtcagtcagcgaaaggaggttaaacggtgtagttatcactccctaataagggtatctacgtaattgcaatgtcgttaagatctatataaacactactcttttgctagctcttatccgacggcaaaaggagaattaagatttttaactttaaacgagagtttcgtttatttactcaaaaatttacttctgaaatctctatttgaatttcggggaaaaaaatcctaagtaagggaatgcagagagatggtcggagtatcgccggtgaagactaagctgtgtgatcggtttaaccgatccgtcggcggcaggaattgccaccggaaacacgtcgaggacgggtgatccagttttctaaactctcgtctctcgaattcttcgaagatatcgaaaaactgtaaatcttttttttcttctacttttttacaaaattctctaatcatcgttgtaaagtaaaaaacc

SEQ ID NO: 4996 - DNA, 2000 bp, Arabidopsis thaliana
atcaaaacggatcacaaaattaagtgtaaaaatacaggaactttcctcagtctcgtcagccatgatgcaatggcccttgatttcatctgtaaaaattacaagtcttttcacattacaaagaagcattaagttcattttttatgttgggaagaagaaaatcgatgtcagtcttcactcagtgtcctcactaagaacatgtacctagaccaattaatagattctctgtttatataccacaaatgtctatgcttattaatgagtagtactattcttttatttttaattttttagtaagacacatttaataaccaagatgatacagagaaaacgggagaccgtaaacaattaaaataatatacgtgacttgtatagttgtattgcttgacacaaactaattagaatgttgaccaaatttggttaacggaatttcaccgcccaattccacttgctttatatgcgatgaacagttgaccagaggagacaaagtgtaacaaataggctattaacaaaacatagaagtaattaatacattcatagtttatatatagacatgttgtgagaacttattcttttcttctttaacaaacaatctgaattcgtttcatactatataagtattatatactacctagttatatgctagctttgtattgactcatagagtcatagtacaaatgctaaaatactaaagctacacagagtggtagaaccagctgaaatatgtttaaaactacatgacctaacccaaccattacaaatttataaacaaactacatcctgaaactccagaatagacgatgtagctcactatgaactataatgtatgtttaatgtcagaaccaaataaatttaaaaaaaatgtcagaaccgtacgagaagaacaaacaaaactttttgtagtttgtttgtatatatttctaagtaaaaatgctgaacacaattatacaaccaatatatgtgatctaatgtgctatttaggaaaatttgtcgatgataagtactacgtcagagtcaaaagacccatattggtttagtccgactattagatacgaaaagtcaagcaaacattacatgtaaattttggtaagatgtgagagatatatatgtctttttttttattttttgataacaaagatgatgctaaaatacttttagatccaaacaccaattatgagattcggaaaaactaatgttagaattcgaaccatgatggccaatattacatgaactcaagtggcaaattttttcactcttttactattggagcaagatgacttggttatgtaagagatatgttgctctcaatattctcatagatcatctctttcttcaaattggtaagatatgagaaatatgtcccatctttttattatcataccaaagtcttttataaaatatatcatatatgtatatatatatattgtcaagaataacttgacttcatacatactatttgaattcggatagtatcacaaaacatcactaccacgtaactgttggaacttcaattttacaaagtatttccggctaacttttcggcgagtttttcagtgaagtttgtcacaaaaataagaatgatcatatttttggaatctttgtaatcgttttcaaagttttctctccggattttcgcggttctacaataattacattacatatcatgatcaatatgtgacctgatcctcgtagttaattaaaacataatttcccggtcaccattcaaaactttctagatggaagattaacaaaacaaaattatcttagcttaattttgtagtaacagagaagaaatgattaactaacatctaatcaagcccacgtgtcataaaccccaccaatgaagaaaaaagagcaaaagacatgcacatgcaattacacgaatacatacaccccaccaccatcctccctccttatattattattgccccttcctctcctttcttcttcccctcttaccttttcagagagagaaacaatatttctaatctattacaagtaac

SEQ ID NO: 4997 - DNA, 864 bp, Arabidopsis thaliana
tgaaatagatccaaaatcagatctcttagtcaaagcaatcagacgcaaatgcctcttcactgtcgaaattcgatcaaatttcactaattcaaatctccagaaatcggattttctggatccaatgattcgtcgtcactcaaaataaaaccgattaggaatgtatcattggatctgcaattctccggtgatgattcaccagcggaacacaaacggcgagatcactcacttcgctgagaaaaattggaatctggattgagaaataaggagagacaagagaagagagtgccgttgagatttatgatttttatcggattagtttttgggatgtcaattttgtgtgatcttcttaattactttctgatcaattaccaaacctagtctctctgattcttttgattataggttaactctacaatttaattctcatttatttctactgatttgtaaactttttcgaaactgtcaaatattacccaccgtgaaaaaaagggatcaggtgttctttactaaacaacatttgttttttttgttacccggcggttgaaaaggaggaggaggtcaagacgacgacgtttaaaaaaccatgggccgtcaaatactctcgtcaaactcttaccagatgattattgattagatattctctcttccatttttcccctttcgaatttttgcatttcatcatccttttcgtgtgcttcacaacttcatctctctctcgagagaatttgcgtcatcaattcaaatcctttacgcaaagtttcagtttttattcactttcttacataacccatcaaaccaaatcctcgatcggattatgttaatcaattgctaagagctttttcttctacttcttcgcaatccgcc

SEQ ID NO: 4998 - DNA, 2000 bp, Arabidopsis thaliana
cataaaaatacgattttaaatttgaaaatttgattagagtgtgattatctaattattgtgttgtctataaatctacacagtcactactttctaccacactgattttaacaaaatcaattaaagttgatcagcacttatttctttcatatgggcttaaatgccaatttacttatatatattttgatgaaaatgtgtggtaaaacttaagaaacaaaaaaatcctaacactaattagcgcctaggtattttgagcaatgcctctttaacttaaaaagaaaaaaacgaaaaaagacaaaagtaattgtcctgctgtcaagaaatgcccatattattattcatccacacaagacacgtacgaccatgcctcttagtgatttgtcattggcccacttcccatcctagtggatcaaattgataataaatactataataaataattacaagaattcaaatagaaaccggcaaatcaattaatagatataaaaaggagatataaatcgttaacattttctattggagcagggagagccaataaaagtcgaatctcacgatatttcgcagttctctaattggctctttgcataaaaaatgaaacctaactaatgggtagaagaatacttttgcaaagcaacaaatatatcagataagatcgtaagctatccacatcacttgttaattgtcctcaaaccatattatataatgcaaacaatttatggcgttaaatccttacgtatttattctctataagagtaaaacacacacactgaaggcaactgatttaattggatttctattgaccagtagaaatacttgttatgatgtcggtcgctcgttggctaagtatttcttataaatatataagacatatttaaaatctttttacattacatacacccacttatgagaaacaaatataataaaatgttgataccaaatatatatatatatatataataaaatgggataattacaagaacaacaaaagagagattttttatgaatttggaattggaatctatcgagtgcatatattatacggacaataatcctcatagcaatacacattttttctataaaaagaaacgtaggataagattatagaaagaagaataaaaacctggaaatggaaaataaagaagatatatatcatgagttcatgactaaacaactatttatagctttttcaataataatatcattcaagagtgaagaataacaatcagatttggaagagaaaaaaatttaaagagagacaccatttaacatcggtaggatctgaacatggttatcaaatctaatactttctattttattatttttcatatagttattatcgttactatagtattatagtgaattaaaattttaagcatcaaaactcaggggggatgaacttcactaaaatgatgtcaatatctcacgtggaccctttatccattccatggcccacacatgggtcccacttccccatgcacacagcccacaacatattcatttctatatttgttcctatactctcttttctctttttcttacataaataaaatactaacttattataaggattattattgcttcgtgtgttttcttctataagttacatcaacagttcatgaaatagaccctaatatagtaacctaaattaaatgccgtatatttcattatgtttccacgaagcttcctttgtgttctttgagttgacccatacacacccatcttacttcccatgcacctgcacatatactataattactcccctcaaacacgcattcttacaaatatattttttgttattaccaaataaaaagtgaaacataaaataataatatcagaagtgacacttgctgtttcttatttccctccccccaagctctttctccttctttctatatatattatacacacacacgtatacatatacacaacataattcacaacacaacacaaacacatttctgttttctccattgtttcaaaccataaaaaaaaacacagattaa

SEQ ID NO: 4999 - DNA, 1367 bp, Arabidopsis thaliana
atcttctattcagtttgtacttgttcagtttttaaattttttggctaaacgatgcatttattgtaaaaccgtcttttttttgtgaataaattttaaatttataaagaaaagaaaaaaaaatgtgtggtagcacaaatgcacgatgttgatcttcttactcaaatgtcttctataaaattgtggacgcaaagtctcccgcccattactctgcatatagcaaaaacctgactattgtttcttaattattttatgaaaaaatgtctatgcacgttatcgtttcaagataaagatgaagatgaaaatattaagttaaaaaggatatgaagaaaggaagtgtgtatgtaaatgatatgtataaaaagataaaatggacattcttataaaagttacacaccatatttttgttagattagtttgtgaattaaaatatttttattgattatttatgcctactttcctaaaattttctcctttttttacaatttctatatcacgactttttctaataaatactttcgtaatatttatcctgaatgtgttgcgacacacttacgatataaagatattttattgtttcaaaaaaaaaagaaattagatattaaaaaaaagttattcaaggttcaataaatagaaaaaaatccgatatccagaatataccaaaagaaatttattcaaagttaaaatacagaaagatattagatatcaagaaaaattattcaagtttaaaaaatagaaagaaattatataatatatagaaagaaatttttattcaaattttaaaaaaataaaaaacttagatatttggaaaaccttatttccatattataaaattataattttactaaatatattaaaaaaattatgtttcctaaatttattaatttttttttaataatctctatactgcaatcttttctaataaaaatattttataatatttatcctgaacgtgttacgacacgtcatcgctacaaaccaaaataaacgggtgtggtgtgtttggtctggccttatacaccaaatcaaacacaccaccatttttacccagaaatttgagtaccaagagagctctttttcatcctaaagagatcttcaaatttagatttcaacacataaaaggtatgaaatttttcattttttttccggctatttttttttggaataatcgtatcataatttctcaatatcacaactttatattaaaagcaaatctaaagaaaaaacacattagattctgtaggaaaatatttgtgtaagagcttcttctccgccatggatttagcttgaaaggtgttctccaaacaaaacccatttcttcgatttctctgataaactcgtcaaacccatttcgcttctcgttgcaaaaa

SEQ ID NO: 5000 - DNA, 2000 bp, Arabidopsis thaliana
ggatataatcattatatttattttcggtcagatcagaatcaaattatttataatgtaataaaaataaaaataattgtgaaataacatccttcttacatgtgaatactcctgtgaaaatattcctaaatatatccctcactattctaaaaacactaatcaacaaaacacaatcaattgatgactacaagtctaaaatagcatcaattacctgtcaatagtgctgtccatatgttataaaaatatttttgttcttcaaaattatatacacacttgatttgaaatatataatttaaatgaacaaatggcgtagaagcatgtgaaaattgattggaaatgatttaagatgtccctcgtgacaagtatagcaatagaatgtcccactaacaccattgattcatccacgggagccccacgaaaacacacctaaaatgataatgtggatgacttgagagatacttttttgcttgcaatagttattaccagaattaatatgacatcaaattgtggcaataatcagcactatataaagtatatatcaaaataagttcttattttccttcttatcatgatctctatcatttggtaggtggttaacagctcgattgtaaacgttacatgtcaaataagctgcatattcccaagaagggccatttttttttccagtcttttaaatatgagaaataatgcatttttgaatattttctctaaattgtttctagattactatttttgttatattatatgttgttttctgattggttacaacttataaatatttgccatttttcatttcacaaaaccatcacaaacagaagagacacaagtacacgtgctttgtgggaatttttttattccttactcttcaagcaaaatcacatttgactcttacatcttcttgagttttcgtacgttatacactcatttggttcatgatcaacaccagtcatgtcttagtcattctgttgaaaaatgtttcgaacacatacccgctcaaaaaaattctatacacagtatgtagaatatcagtcataaattcattacgaaacacttcaggaaaaaaaatgaatttgatcaaaaccaattaaaaagccaaaaaaaagaatactccaatttccaaatgttttaccaaatgaactacttcttgtagtactatgaactagtacaacgactgcttcaacagttttattttcattcttcgccttctaggaatatcgctttttgtttctcttcatctttttataaaatttattaagaatacatcaacaatttctttgtaatctttgccttagagactacaattaattgttactttgtcgttaatttatgattatttagcaacaattttgtcaaaaaataacaacgaagttaccaagggtgtgcaatatatcacaaattgttcggtttgttatagcaataaattttctgtcactaattccctcgttaccggatgcattttagtgatgcagttgtgaacttttgatccatttttagttaaaaaatctctgaaatttggtatgtttgagtgaaggaataaatcctttcattttggtcaaaaccattttgtggaaagtgaaaaggcacgattgcatcaaaaaatagaatttcaacttcggaaatgtattacgagaaccagaaatctaccaaaatagatggtcaagatgattgtccaaaagtatagaaatcatgcagatttagaagatcatcatacagtattttactttagaaatttttacattaaatttatctataaagattaatttattttttatttctatttaggacatttaatttacatgtcctaaacaattgttatttaggaaccgtaaatggacagcctaaatattcttggatttcctaatgaatgatatttttaacaaaaattgaacccatataaggccaagaagctcttcacactactttacctatgtatatataaactcgaatccatcacaaagcctattcaagttaagagaaaagaaaaaaaaaaccgttcttggaag

SEQ ID NO: 5001 - DNA, 1641 bp, Arabidopsis thaliana
gatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagcttctcgattatattctttttagctttcacatttggttttaagtacataattaagacatacatgaactacatatataatatatattttaactaaaaaaattgagtgtgatataggttggtttagtatataagctatactttacctaaagtaaaatcagagctcacttttgtgtgtgtgtgtttgtttttgttagtcattgagatttttaataaagggagattcatttgagatgattgcttctatagtttagagaaaatttgcaaaacaaaaagagtatactatatattgtcgtttcaggtaaaacgatgcaaaaagtcagcctagaaattaacgaagttacatgaccatgaccaacatatgaaaactgcattgtttaacatatctctgaaaagattatgtttttggtcgtattaaaataacaaaaacgaagtaaaaaaaatctcagatgtgaaatcaaactaagaggagctaggagaagaaaaataaaccctaatttccttgggatgtaaattttcaccggtcgtacaatataggattttatgtgattcaaaattttagtccaaaagtagagggttataagtttctcggtttgaataaattaatttagtgattttgatttagcgcttaaatttgattgtaaacacagttcactctattatatactattgtccaatattttgcatactgtaatccacttttaacctacaaaaatattgatataattagtccggtttactgctaattgaacaaccattcaaaatttgatttgttgtatagacaatgagttatgcctcatcagaaataatcacaacttaaaattattctagtatgatgaaatatgtgttctgttttgtaaatattatagatacaacctataaatagttatacaagttacaaccaatgagcataccgaataattcacttgactttaaaacaaacgtatcttgaattcaaagattaaagattggttgtaatagtatatatgcacgaagaaccaagaattgctcaatttttaattgatagtgacatttgaatagaacgaaaaagattgaacactaactaagcaatctaccaaaatattaaaccaaaccacataatatcaaatatcttaaattataaaatagcccctatatttcctctttatctcataaaacacccgtttcttcttctaatcttaacttcttcttcatcaatcacacatcatctaaaagaaaaacaacctacgataaaattcagaaactttttctctgagacaccaaaaaaggaaggtgaccctccttctctaatcgattgcttaatcatttctgccgttggattgaatcgaaaaagggcgaattatttaaaaagcttcagaatttgaaatcgaaatctgtgagtactgttgtgtttgtggaagagagagttttggggtttaata

SEQ ID NO: 5002 - DNA, 1170 bp, Arabidopsis thaliana
gtcttcagactactttaccaatcatgcgaggggttttctgttctttatatatactagggttttgtatcaaatacactagggtttttgcgttttagttttcctcttttttttttttgtaaatgatatgtttttattttactatatattatgatcgtagcatccaatatacaaaagctcttgatggaaattaccgaggcatttattttactatatataacaaattaaaatatcaaatatatatacaaaagctcttggtcgtttttttttcttcttttttggtacaacattcagaagctacaaactcaaatacggagttggcgtatacatggaccaaggatccaatagaaacatgtatagtattaattgagaaatacaatgtgaatagcaataattatttttaaataaattactgaaattgacagtgaaaaaaaaaagaaactactgaaacagcaaattgaataccctcatcaaagggtgaaattgttagaaacataattgaagaatcgtggaagagatcacatggttatgatttgatctttaatacaacttggtgttaatgattttgattttcaatatagaaaagattattgtcgcttattgaaccacaattaacaaattacgttactaattgtattttacatatactctaaaatcatcaaatagaagatgtagttagttaaaattgtcaaatagaagatgtagttagttactaaattctaatctggacaaaaataaagatgtggttcatacgtgtgagaagagacactaccattcttttattacatttcgttgtagtgaggctttttctgttcagtcttaaaatacaaattaaactgtccagtgtccactacactaatcacttcatgctacggcccgctaattaatgtttaaatatgtattgatcggatcagaaagaatatttgtatgatcaaaaaaaaatctgttctcttcctcacagcttttctctcagatctgtttgttcgggtttatttttgctctcttgcttagttctgtttttcactcaactacaattctttcttaagtttctatggttagatgaacttagactgttattgtttttggaaaaatccgtagatctatccgtctcaatactttgataaactaaaatctgtttctttttcttataaaattgcagattttgtatcacac

SEQ ID NO: 5003 - DNA, 1516 bp, Arabidopsis thaliana
tcattggtgtctcgttgtcctactaacctgagaaagatatattgacccccaaaattgtgtcaaactataatttttgaatatttcataatctttctaggaaaataggaaaaagacaaaaaaaaaaaaaaaaagttctattagtgcggcttatgtaatttggaagagtagataaaagaatcgattgtgatgtagatttataaatttcaagtctgactttctgaatgttaaatgttacaatacttccatgcatatgcatatgagatatcattactttaaacatgttatctataccaaaaactcaacaaaaccttgtcatttgaggcctaaatcttagttgaagccaattccgaaattagttttagttttaacttaaatgatttttagtttataaattaaacaagtataacatatgcttaatgattgtttcggcgggcttacataaatgattgatagaacatgttatgcgtgggagtagtcgttgtaagttcaccgtccaagtctccttttaattaattcacgagaaatcaactacgaccgtgtaaataaaatacttagtttggtaggtcaagaatcacttctggaaaatgagactaaagaaaagagtcacttgtggaaaatactatcaagtggacaaaaccaaattcctcatagtgaaaaagagatatattacactgttcctgccgcatttgtttggtacgtatctaatatttttgtttactcacgtggtactataacgcttattgccaatataacgattaggacaatttgatttctactaattttatttgatacgtatcaaatatcttctgtcttagctggtcatcaaattgtgtgaaatagtaatttaatactaactcgttactgattactgatgtagattcatcttcgtaacgatcgcccgatccatattccaatatttgcattttgttttacgtaatgcactctttctcatctgtagctccttgagtaaaacttaaaacttaaccatgaaggcatctgtaaattgacgcttgtctgaatttctcaacaccaaactctctttcgtgtctagaggttctttggttttcccacctgcttttcgattatggtaatggtcaacttgacgcgtaccaagttttctgatctttttgaagatatttcaaatatggtttgctatttcgattttcgacaataacagtaaaaccccattaagaccataaatcttaaaaattttcataaccgttttacaatattcatttatgtagccaaattaaatttgtcacgtaaatgtgacaattaatattggtccacatcattttgctttcatgacaagaccggccatttagtgacctactgtatgttctacaacaattattggaaaatggaaattaaatatcccaacaaaaaaaataagagcagaaacagagattcactttgcgaaaaagtcgcacgcacacatataaaagacaggactagaggaacagaggaagaagaagagtcactgtgatcaccaccaccgtacgatcaaattcaaact

SEQ ID NO: 5004 - DNA, 2000 bp, Arabidopsis thaliana
aggtatatatgtgaatacacatatattaatgtatgttggtaaaattggatattgtgatatgaagcaactcgtttggaccccctttaggtgaggtggtactatcaatttacgaaacgcaaatcatgcatattattcatcatgtctacctatatttgtaagatttagttttctctaatgattaatcaagtactatcattagtaaaatctctcgaatatataatatggattgcaaaaatatcacattaattaccaatctttttttctctataaagtaccagttaaaataccacatagcagaagttatattcttaaacagatcgttttctaaatttcatgttaaattatattcaaagtacaaatcttttgtaatggtatttttaaaaatgattataaacttgatatttcatatagttagttttgttgttttgtaggatcatgtaaattgctcgtttttcaaaattgatgactatctatctttttgactatacatgctttgtctaattgtatgttactttcgacaccttaatttgttgataatatataaacaagtgcttaaaagagtatatatagaaaaagtaagggggttcagttgatctgaatggaaagttaaaaaagtgatcattcatcacggtcgaatttgatcatatatataagtttatggtaacgtataacggtaaaagccagtaaatttatagaaggaattccaaattaaataattctttaaaatttcagttgaataaaagttcccaaagttaaaatctttttttttttccaagacataatcaagtaacttaagtaaatgtcggttttagcacaataatgcaagaaaggaaacctttagatctctattggtcaaagtaggggacagtgatgtaattcaagtcatcgatctactgactactggtgtttgaaggggattaccgacaatgttcctatgacggcgcgtaccttccacgcgtctgtaaaagagagagacaactaataatacaaatcctaacgcttaagctctactatatcgttttaacagtagtgatccatatatatgtcctgttgaaattatttgttgaacaataagattaagggatcacaaaactactccagcatatactacttggatatgtagctcttgtaaggcttaatttagatggtaagatataaacatcgaatttaagaatagtcatcaagaacagcttaggaaacttcaaatggcagatcgaatttggatgacaagtaagaacacggtgggggggtttttttttaaccataaagttatgcttaacgtttagtgatgtggcttcctaacgaatctatacaacatcaagtcatcaaatgtaagtacattttgttgactaaaacattggaagtgcatggaattcagacactagactaaagataaagatccttgctttcattgggctgctcttttttggtcagcttaactttttgacttaagaaaaaatagtctgtcaccttccctcaccaactcctagttcatttcatttccacttcaacctcttcagaactaagtaaactatatagtcttcgcatttagctagttatgctttataaattattagtactaactttttggcgaagcaatccgcacacagattagcccattttccggtgggtttaagaatcttcgtcgtgactaaatattcagtaccaaaacaggcccatttatggcccaatataaaaagcgtcgtccgtccacttaaactcttggcgatctttcccacttaaaaaaaaagcgattggcttatccctccgttgaaaagacgaagtaaaatcagtcaaaacacatctccaccgttcagtcgcttcatcacatatatccaacggctgaaaatcatctaagcctgtggacttggaagcaaagagataatgctgaggcgcgtgaggcacagtcgccaacagaaaatcgggatgtttttttttaactgcaaagccaaagagacaattgtatggtctctggtaaaggtaaggcaatcaaaaaaaat

SEQ ID NO: 5005 - DNA, 922 bp, Arabidopsis thaliana
tatataacactcttttgcactcaattcatcaataaaggaacaatctttgctcttcaagatcgtattctgctaacaaaaatcaatactttagatatcataacacaatttcagacacaaagaatcaatatcaacttgtgggtattgaaaattacaaaagttaataacgtaatccagcaaaagaattgtactttattctagttctgagctcgaagccaatcattactacccaaatttgactaatccattgaaacccaattaagaagatgaagaatcacttcaaaatcaaattttgcatctatggatagattccaaagacagagattttgagtaagatcttaaagagcaaagccaataacgcacctgagagtattgtcgagacaagaatgtgcaagagagtgtgtgtggcacagacaaatcgagaatgtgtgttttgttttttcttttttctgtttctcagttttttttttatccaagagttttttggtggcctaattcaaaccaccatgcagaaaataagaagagataaatataaaatggtttcaacaattggagaagtttagattatagtgaaaaaaacgaatatgataattaggagatataaaaaaaaatggagatatggaaagaagagatgggattggtggaagcagatactggctccatgtttctgtggtattcagctacgtctcttgtttcgctttcgctgccttctctctcccatttacatttcttcaccattaacgattaaggcccatttgagcccatgattcattagcttgcgcaaataaatgggccgttgaccaacatataaattggcccaaattcgtcacgctcacgcctccacccccactcagatccacatattaaaaaaaaaaaaaatcatttttgtgcaatcaatcagacgagaagaagattatccatcgcc

SEQ ID NO: 5006 - DNA, 2000 bp, Arabidopsis thaliana
gccaattggttaatatatgttcatttttaaaattttgaatcataaaatatgatggaaaaaattaagatttttttaaactctatatattatataatgatgttaaaaattatgatatatcaaactttttataagtttaaatattaataatgttttataaattttaaatatataaataataatatttaaaaaattaatatgtttgtttataaagtaatgacataataactctaaaagcaaggatttagaagatttaaatctttaattaaatattttcattaataaataattaatgtcagtgacatgacattgtaaataagttcaaatacaaaatttatttatttaaacaaaaaacgtttagtaagaataatatttatttaacaaaaaactttgttttaaaatattgttaacaaatatgtttatgctaattttaagggattgatttgaagtttgttaggattaaatttgattgataatgtgattgacaatttaaataaaaagtttaaagtaaaattaattattttggaaaaaaaaattaatgctaatgacattagatcgtaaataagttcaggatttatttgctaaaatagctacaaaaatgtatatatagatttcaaaatatacttttttaatcactattttttcgtggagtagctgtctacgaatgttctatccaatacattcgaacacgtgattgttcgttaattttcttgattctgtaagagaaacaaaaaatatagatgtccaactttttttttcgggtgggaatatagacgtccagcttagctacgtactgaataattcaaagttccaaactagtatatattaatacaattgacgataaggtcataaggatcgatggattccaacgattcgatacaagtattaatgaaataagataacacgattgtgacagcaaactctatattgatatttctattttttaattagccatgcgttgcacgatcaatttacaaaataataaaagaaaatgatcgatcaaagagcattccattgaaatttaattccatcctgtaatcacataattttgggcccaatcctatttttcaaatgtaacatgctattacatagtcacatagaacatcctaaaatagggttaaaatgtacttttatctatttgcaattttgatattttcctttctgaaaaagattagtatatggcaaattatcttttagataaaagatcttttgttctgactatacattaatttattttaaaaaaaaaacttaacagatatatttgcaaatacaaaatgatgaaaaataaaagggataccataatctaaaatctgacaaagaaaatatacaaaaagtcaattacgatacttagaaaaagaactatatatttttgggtagggaagttcaaaaacaaattaccgatttgctgactatatgagcaattattacatacttttatttatttgtacaacaattattacacatacttgtgtggaccaacatgattaattttatattggccatatggtgcgtagtaaatgttataataacttgaaattaaataataactaagctcgactcgatatatagatccaaccagtagcctctcttattcacacctaatcttcatcttcatcttcgcattcatagtctctacgatcaggtaatccccctctctctatctatctttcatatatgtgtgtatgtgtaaactatctatattctgaaaatagatcaatcaattgatcttttcctatctcaattgttttcacaaccatcagtttgacttttgatcgtttaaggctcgagagaattatcattcactgtagtaaagatagtttataccaacaaacccatttggtgttgaccagctttcaacataagtatgagttagagctagaaccggattagtattaatgttacttgtacctgttcatagtactaaccaaaaatgatccaaaaaaatgaaaataacaaataaaccatttatggttatcacagatagataaaagaagtcaacaacg

SEQ ID NO: 5007 - DNA, 2000 bp, Arabidopsis thaliana
cagaagagagagaactaatttcgttattacggttctcagatcttctaatatattgtcttctatagataaatattttgttcatcctaatagtttcatcaagaatccaaagtcaattgctcattattccacgaaatctaaggggcagctagaaacaaagaaaatatgctaacgtgaagaaggcgaaaacttgtcattttgacgttataatagaaattcaattttccatcgccgggaaaagaggaaatgtacaaaaataaataaataaaaaatttgaaaccgttcacctaattagatagctaattgaaatttaacaatagtttaagctgtctttctggactccattcttaattgacttattatagttttgagctttaagaagaaaaaaaacactacttacaaatgcactattttagatacgtgttatatgtaccaaagaaaattgcgacgatatttgtttagtcgcaaatattaacaactattttaagaccgttgagtgactatccacggccacggtgcatacatagaatcggaaaaaagtttcatattaacaaccattttgatgcatattttagatactctatatatcgtcagtgacacattatataatttatacatcttgaaacataatataaatttaaacaaaataaattggttaaaacttttgttttcgaattaagttgtgtttaatgaatgatagtggtttcatttgctcattttatatatagatttactgttttcaagatatcttataaaaaaacatttatatcaaaaaatttataaacttaaaagtttgtttttttttgtcaaagagaatctccaaaaaaaaactaaagaaacctatctaccatgtaaggaccggattttaaaatttaggcattaaatatttttataccgaaccggaccaaatatatttggttttaagagtttttagcaagatcgaactaagttaccccgattgacaagtctacttatttgcaagaaaataaagaaactttttttatttgtcatctcaataacttatatataacatataaaaaattagcgatttatttaatccctaaaaaagtaactttaatatatattttcaaaaaagaaattttaacgaataaaacaatttagataagaaagaatttgtctcttcgataagtaagttatatttgaagacaaaaagtttagttgcacgaagcgttaagaatgttttataaaaaaatcttaaaactattatactgaaaccacatttatataatcacgatttaaattgggttctagatgatttgtgattctttttattttgtaaccacacttgttgttgtttgatattcttgttccgttgctagaagttggactctaaaatatattcatgttaaagcatatacaatatatttttatatttattttccacacttccattttgctaatttcaattttagttttaatttagtgagtcaaatatttttcaattatctatgaaattcaaagatacatttcgaaagatgattttaattatgttatctcatcaattatattcataactataattatatattttaggtgtacagaaataaatcactaatcgatgcatgtaaatgttgatgtatatgaatgtaggcattatgaaattcttactaatatttatgtcgttaattaatgtttggatttatgtagacagcatacgtcctataaaccaagagatgattcatcctttttatcatccggaattcgggatctattaatattgtttagtgttaatatacaattaaaaaaaaagttagtggtgatatacagtgtatacattattttttgaatgaaattttacagtgtaggttattaaaaataattattagaaatagctgttgttaaaaataaaaatataacaatagaattagttcacaaaatgttatggacccattcggtcattcccctataaaaggatccttgaagatatagagtttcctcatcttctcaaactaaatcaattaaagaggtttcttcttatagaa

SEQ ID NO: 5008 - DNA, 2000 bp, Arabidopsis thaliana
ttttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacaaaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaa

SEQ ID NO: 5009 - DNA, 684 bp, Arabidopsis thaliana
acattacattctctctgtttcttgttatgcacatagcaatttctttcaaacaaatttcatctatttatgtccactttgtatataatatttatgtgtttttagttggtttttcatctttctatagtctcagatttgggtttgtatataacaaccattggttattgacatttagatcaaaaattcgatatcatatttgctgattaagggtacttaatcacattttggttcgtttaaattagtatctgtctatctgactatgaattacagtaaccgattggtgtttcagtcaaaccgacttgttttgatcgttttggggagtaatttggtttcggtatggatcgaattggctgaaccggaaaccagcaatttgagtgaagcacaagaccgcagtacacgtggcttcttctaactggggtaagaaattatttgacccaatcagattgtacctcatctagattttattgccaatggacttgaaacatcaccagataacgcagagtttaatagataagattagtaatcctactcaccgtcagatggatttgtgaatcgatccaacggtcataatcgtctttccaagataggccagctccgaaactcacctccacgcatctataatcgtgtatcaagaaacggatctttcttctctatcttctgaatatcacaaaacccaattagccggag

SEQ ID NO: 5010 - DNA, 2000 bp, Arabidopsis thaliana
tatgaaaagaaggatgaaatacggatgtcttttcatgaagatttataaagagtactaataacttcatatcttatgattagaaatctaactttgaggcccttgtgtaccttcgaatatagctagtttatagtgacgggacccttagcataaccaaaatcactgacaagccatagcattccacgtggttaagtccatctatactctcattatcatcttccctccggttcgggttcacgatactggtttagcaactaaattatcaaactatcaccagtttcgtagaatttattcacactaaaaccaattatacgttaaatcattcgttagtcttgtaacttttgttattacttattaaacgccatggcgatgttgggtccactaaacagcgcagccaatcacataaataggggaacacgccagttagattgtatttttaataactgttgtccaaacgtgtaatctccaatattttatctgttccataatgctaatgacaaacagaatagaaaatgagagagctatagaagtcatatatacagatagatataattggactcagattctatgtatatagttgaagatataataaaagataaatctaaaataccatactttgaagaatcagagaagaaagaaaacagcatggccatttgttggcactaaataattagtttatggacacaagtaagacaataaactgtactgttatagtgttttgtagtcaaaagtgttccacacttcatgtgactacaccattacactcattacaataatcaatagaataccaaccaactctataatataacgtgttaaaaacatgaaggtgttaatatttaaataatagggcacgatgtttatatgcgttcttaagtttttctttcagtagttgtgtcttgtatatcgatatatatgtagtggtcttacaaagtaggtgtatgtatgaataaaacaatgttaacaatctaatcaaattattgtttactttggagtaaaacaagaaaaaaactcaggttgattatgattgaaaataggatcaaatgataatggataacgcatatatatgtgtatgagaatgagatatttgagaaattttattttcggtagaaatttgcacagaaacgtttagggaaaatgttatatgaaaaaatagttagaaaaaaaaatttagtgaaaattatttactttgtttgtgattatcttcattagatgtcatatataaatatggacatatccatgtttttctaaagtgttggcgctacatcaaccaataacacgttttattgtttgatctgtagtaattagtgagtagtaaacaacgaagcataaagcttcatctatttcatagtcgttggttgatcaattttttttaacaacacatttcaatgactagcgacttaaattgttaatcgctaaaagtaaggtttcaaattttgaattaacgattaattactaaaataagttgttgtcgtcaacaattacaaaatgaacacgattgctacaatatgttattgttatagatctttggcaactgcaaaacgaatataatttaatcacgtacgatacgactatgaaaaatcaaacttcatctaagatatatgttttggttttcattttaagattaattaaaacgagagtggttatgtattaaattgtttttaaatttataaagaaaaacaaaacattttttacatgtttcaagaaacacttaaatatttatccacaaaaaataaaataaaacaatgaatctttatttttcattcacaaaggaaatctgaaataagagtaacctaaaaaccacgtcaccacattatccttaagaatagatatgtaatgtacacgtggcagatctcaagtggagggaaacgattcgtttaacccaaaacatctcaaacaattcctcttttcttagccttacgaacatattactaccaacaaaacaatcaagaaccactctttcgtgtcgcaataacaataagaaagaaagaaaaagaaaaccagag

SEQ ID NO: 5011 - DNA, 2000 bp, Arabidopsis thaliana
gtcattgatgtaagatctcttaacaaactcttttttcaatatatttctaatgtgaaatcggataattataatatgtagaaaagttgatacaatcatttactttcaaattaattatcgtctaattcatataaaatcatgcgtagttgtggaactttatttactactattagtaacttattttactgttataatgaaattttgcgtgaaaagcttcttacttgtgaattaattcgcatttggcattacagtgacatgccttgtcgcttttttccagtttagtgtttttttaatcgtatattcgtatgagagaatatcattaattaaaaacgttaaaacaaaacattatcaactcaattattgacaatattacagcatcaaggaacatgttcgtgaccgcgacgcccatttttttattaggataattttcttacattttgttttattgtggatcccttaataatttcatagaaaactaaaaaaactgtccctaatacggcaatcagggatttaatcattttcttaacgacgattaaaattaggtctaatacattacaatatatgtatgaaaacgttgcatcgtctcgcatgacttaattgtctcccaaacatgtagtatttgatgatctttgacgtaatttttttttgttagagtatctttgatgtatatatttatcatccaatttataattagtagtgtaatgatatcacaatacagttcttacattttgaatgacattggtttccagatttaacttcatatgtcttgccaagtaaaatttgtacgcattgatatagtatcatggtcctgactttaagcattggcgatgggtaatgatattaatgaaatatcggcgaaatttcttggataaaaagaaaagattcgtacgcatgaaaccaatatgtgatgttggttccatattcacatagcatttgtaaaatttagaataaaatcgagtttacgtcagagccatccaaccattaccattaaaaattggatgaactgatgaacaggttgaaccagaaattgtcactcaaagttagagcttggttgataggttcttaagactaaacagttcctcatcagtatgtaatataatgaaataatttaatctctttgtgtgtaaggtgttaactggactaccactagactgaatttttaattaagtcttatcctatagtcttttcaataagttcacaattgcaagtacttaataaacaaaataattaatcagttaattatgacaaattagtcaacatccgatcacattccacgttgtaaagttaaattttaaggtagatactaatcatacttgtaaaatgaataagatgagttcttcttcttgtcacctctcgatcttgttttaagtagttggtgagatgtgataaacttgtaacatgccactgagttgtcaaagacaagcatctatacagttattaaaaaaaaaggttaagcatgtaaaaatacacacacatgtcgtagtaaatatacacctttttataattaattatattgtaacgaatttgttgttttgttataatatatagattaatgcatgatgttttgcgattaaagccagacgagttgtaatatccacagccttgataagctctacatgcagtgaacaattttatacatttagaaaaaataatcactatctcgaccatatagaccaggccactacattacagctaatctctggatttacttgataattaagacaaatatagaacattaaaatactaactcgatgcctcaccttagcctcctctcaaattgtcaatatctagatggagtgttacatccacattcctaacagtttttactctttattttaatatatccttcaacagatcatcatcagaataatcatcaaatcattattatatatttaactagcccaaattgtaccatacctatcaatttaaatttctctttctatctactataaaaagtgactctctaagaactccaaagattagaacattgaattgaattagcc

SEQ ID NO: 5012 - DNA, 997 bp, Arabidopsis thaliana
ccaaataaacaaataaacattttaacataactcttcgttgtctgaaattttaattttaagaatattttgtgttgcatttaggtatatctgataggttgattagatcaaatgtttttgtgttttttctctgccaaatgttcgtgagaatgcaagagatattcaaattgtgttcatcaaaactaaaatttatattcaaaaccgtggatggcaaactatgcataagataaaatgtacataatttttgttatcttctaaaataaatgtacctaatttaatagcctaataatatcttctaaagttattaacttttgtttatgacaatgatgatgataggagcattttcgatatttccaaaaaaagaaatggaaaggacattgcaacaaaattgaaaattcaaacaaacaaacaaaataaaaagtgcagctaggggataaaattcaaaaggcaggatagaaaataaacaagaaagaattcatgaataaataaaaacactagaagttgaaattctgaaaaatacttgaaaagaattgatacaatgaatttgatgattcattgtccgaattagactactcacagtctcacataaatatcaattctaaatttttggttccaagatctcaaagtcttcacttctcattttgtaaacacaatttttttcaagggaaacaaaaattgaatcattttacctgaggaatattattgggctacaatgggccgtagtgaggccgaagtcacaccttaaatagaacgtggtagaagttactataatattagagttacaaaccagtaatcacggaagtagtaaaaacggcccatagaaagtataaacaatccaacggctgaaaaagcttaccttggagaagagtccaaaatatcttctggaagctaccatcactctctcctatataactcaaaattcaccatcatcttcatcatcatcatcatcatcatcctttctttatccaactttcttcaccaaatcgattcttcttcaacc

SEQ ID NO: 5013 - DNA, 2000 bp, Arabidopsis thaliana
actagttcattgagataaaattcaattgatgatgaaaatcaaactaaaaaaaacgaagctaagactgaagcataaaagagggtttttcaatgtaaatataattatttttgtttgtaattgtctacaatatgaactatacaaattttaattagagtaagtgaaaaataaataaattagagtaagtgatacatcaaggatattaagttattaacacgatgacaaaaaaaaaaaaaaaaaagttatttacacaaaccattgattaggtattcaatgatgggcctataaatgttggggctgggaagtccaaatctttttagacgttggtaagaaaatgaggcaaacccgaactttgattttgggatatgaaattgttttatattcttgcagagttgtgacagaaaggtccaaaacaaactttgttcaatgacttgatttctattgggccggcaatgttttcaatactcaagagccttttaatattcttaaaatagtttttttttttttttttctattttgcaaacggcagatgacattttgtaattttcgtatttgtttctcaaaattttgtatggacctagttaaatcttgaaaaataatataacataatcaaagttattatttttcacatacaagatacatgtaaagtataaccactaaaagcaataggttttgacttcatataaatgagtgaaatagctagaaggaaccgcatgtaaacggactgagtctgtacaaaccatgcttcagatttcatccagtaattaaatccttacatcaggaaatcaatcagaagaaacatttaggtatctcatgatttgcttaactttcttagattaatgtttctgcccttagtagcaataaagtaatctaggacaaaaaggtgtgggtctcatttttctcttttacagacaagtgatgaaaaagacatgtataatctttcatgccgctataccatgaaccttccgttcgacttcttcactctactgtttattgcatttctgaccagtagaacagataatccatgtatagaacagttttgcaaatataaattactggttagatatatatacgtatagtcaaatatggcgggatattaatcactttaatattcatttagatactaataaatggatcaacttcataggtgtggatccttggatgcacatgcatggagaatagtcaaattcaaatatatcaattcagaaaaacgaagggtggtcgaccaagagcgacttttcaaaccatcaaataattgataaggacgataaattttatttctttcaagttaatataatacatatataaataaacatatcaatttatatttggctcgaaaatagtcatatttaattttaaataaaataattgaagataacaactatacacacatatattcgtaaacgtaaaagcaaagatgattactatctaatttatctatgataaaaaatcagatccataatcaagttgactgtgcatgggtgactggatctaaatttctaaacaagacaaacctaagattaaaataaagacgttttgattattgagccgttttatcatatatatatacgcgggacgacctattctaaatctctaataatatttaataaaatgctacttgtgtttctacacaaaataataagcgaacacagtttgatttgcccaagcgtccaagaccacgaccaagtccactgaatattaaaaattgagcgaaaaacaagatttagaaaagtttttatgattttgttcaaaaaaacaaaaaaaatatgacgtgtaaattataaaatatcaaagtgtccagagaccagttgacaaaaacatccaatcctcaagttgcataagttcgagctgctcagaaacttcgaagttcctcacaactcttctttacccacttttcttatatctgctttccaaaacagagaaaccccaagaaaagaaaaagaaaaaagaaaagagaagaaagaagcaggaggagactttttggaatggagagacaaaagagc

SEQ ID NO: 5014 - DNA, 887 bp, Arabidopsis thaliana
actacaccattaatctttttgcacttttatctagtagatttagatatcaaccaagtcaagtatttaataagttcgacgaaagaagaattacttaggaataaccatttttactcttatggagtacaagtgtttagtgttcaaaattaggagtggattatctggtttaaactcttaagtttggtctttttgggcttttgatttttcgaagttcttaaatgaagcgaaatcctgatttgtttttggacttttcattcggtttggaacgatatttatatgggatgatatattacgggtgaacaaatatcaaacaaaaacaaaacaaataatataaagaaatacaacttaaatttaaaaattttaaaaaatcgattattggtgtactacgggttatggatataagtaacaacattctttataatatttaccataataaaggttactgtttaaatttattttcaaagtacaaaaagttttcgattcaatttgattcggtaacaaaaaaaagacccggttttgtttattccagattcataagatcataaaatagtggtttactaaacaaatttcaattcaatttcggttcgattcggttacgtatacaaaaccatagcttcgcatagaaaaaccattattttcaaaaattaatatttttaattacaaaaaaaaatgaaataaaacagagaccacaatcccattgtcccatgaccagaagaagaagaagaaactaaatggcgacgacgacgagttgttcgcttctcctttcttccactctcttccttcactctcctccttcttctcacctctccttcttcaatctctcttcttcacgatcctctccaatttctctttacccaatccgatccaaacgctatttccgaatcctctcg

SEQ ID NO: 5015 - DNA, 2000 bp, Arabidopsis thaliana
atccataaatttgttagtggtaaattttctccgagggttggcaaaattttgttcaccaaccgtaacggaatttacactcacaaatttcaatatctctaccttcttttcatctcttttggtacatatcattaactcctttccttttcaaaagacaaatgtatattaaatagcaagtgattcaccatccaccaaatgtgatcttctgattagtgatatttctttagacaatttaattgatggatttgaaaggaaaaaaactttgatatatatagtatgaagaagtttctttgtatttatccaagaactgttagttcaatcacttgcgctttgtttacgaatgattaatgacgttaactattcaaatacgatgctactctgttgttgaattcatgcgctttgttttcgtctttgatttttaataaatttacatgttcaatacaaatatcttttttattggtataacaaagaaccatgataagactgatacataaaataagatgttgtcatgttcttatttaactactatatacttatattgatcatgctcaatgggagtttgtgtatataaaaataaatttagaatttttctttgtttttttttttttgggcaaaagaatttttctttgttaattcacacatttccatcaccaaacattcgaagtatttgtctctatctcgacaacatttatatatatttttttcttttttttgaacacgactcgacaacatataatacactcctttgtactgtatactacaaaataaactactaaacaatattgactctataatatataatttatatatacatacaatacaagtctaattcaatcacttttggttcaaattggaaaaacattgaattcttctattattcttgatgaccaagtctatatcacatgtaataaaagtacacataaccggtctttctttcttattcgtaagctgccatgcaagtggggcttcaagctttcgtaaaatctctcatgtattccacattattaatcgaatttaaagtattttgcatgttatttagattagaaatgtcgttttcttaatcacactcctaaactgcggatcagatataatcaccaagattaaataatataaaaatataatcactacttgccaagacatgaatcatgaggaaagttctatagcgtgtactaacatacaataaatcatatttatgcgtatacatttactagaaccataggatcgatgaatcagatgcaactcatgcagtcatattacaatatatatttagatatgttcatcttgatctttcaacttaaaactcgttcatattcatcatttaaaaaaatatatatatgaatgtaaaaaaatggtaatttaaaattagatgagaatggggaacaaattaatcaccaaacaaaaaaaacggaatagagtaaggaagagagaaagagtcaatgagtgggggcggctaagaaaacattataagtttataacttatgagttttatgattaggaaaattataataaaacttgttgtcgaatagtaaaattataagaaaactaagatattatttctcagtcaaattataaatgatattgaatatctagattctgatgtaggagcaaagacaaaggagaaaaacattagtctccccccttctctgtcatttcttaactctactaatattttatcacataatttatcatccaattttccaattccataaagtcactttttgattcaattttattttaattccctatactttattgacatcttccatcacatgaaggactatctcctccagctattatatactctctctctctctcctttattttttctcaattcacatataattttcacctttacacacatttccatgtaagtatatataaacctcacacacgcattatcatacaccatcctcctcattctcttcatcatcaacataagagagagagaagaaaaaaagaattacaattaataagaacaagatcaagaatcaagaatcaagaaa

SEQ ID NO: 5016 - DNA, 1050 bp, Arabidopsis thaliana
aacaccaaactcgccgtctctacaatattagttctggtctaggttttgatcttcaataatagctgtggtcggaaggagtaattagggtaaaacataagggcgaagacaagaatgtgtagagcatgtgatttgttcaagctttaacatgtggatgtcttatttttaatgactgctctttaatatgtgggttttgtttgcgcatttttcacttgcgggttatatttttcaaaagtagtaaatgatgggaccattataaaaaggatgttattaggactccagaaaggaaattgattttatggaaaatcacctttttacctcaaagttttaatatattactaattaagtacccttacataagaagctgcgttgccaagattgaagagggtggtggactttgtaatcaaagattaattaaaaagagagttaagacaaatctcagcggaaaactcggcggtgatagataatcaaaacaaaagaaacgcgtttttcaaactggttcaatcttcttcttcgtctttcttcatcgtcttcttctctatacagaccttgactctctcattaaattaacaaatgtccctacggtttatgcaagtgtagtgctattaaactatcccttttattttcccacccaactcaatttattttctcattctttctctttactcttcttcagatctctctgtttctttctttgttgttgttatctggggatgctttctactctctgtttggtttccttcattgtgactttctattttctgggtttgtttcaagtcatgatttttccgatacccttttgatttttcttgctatttctcacctctgtataagcaagctctctgctgtttctcctcatccaagttgggtttatcagttcagctgtgtagaaattcaatcgtctgagaagtccgaggtttgatgtctgatggttttaagatcgaaaggatttgacttttatcagattagtaatgagattagattgtttttgaggttattgtaatcagatcttgatgctatttctggtgaaagagatttaagacaagttaggga

SEQ ID NO: 5017 - DNA, 2000 bp, Arabidopsis thaliana
gccgacatctttaatctccgaacacagttcatgcacttaggacacattacatatacacacacatatattcatgcataagcattcgttgatatatgcttctttgattcctttgcttacatgctcaacgtgtttactaattaagcttgtttccttctgtgcgtttattgcttacttcattgtttgctttcttaattattggtttctttgattcctctacttagtgtagtacttgtttctttgcttgtttgattcctctatagagttgtacttgtctttttgcttgtttgattactctgtttagtgtattacttgtttctttgctttttgattcttctgcttagtgcattgattgattcttttctctttttttttgcttctttgttttctcgattgcttccttacatgcttagcggctttgtttatttgaatctttatttcagtttcttagtgcattgcttaattctttatttccttaatgtatttgtttgcttccttgattcctctgcttacttcgttctttgctttttcgtattgtttattctgtccttcagcttccttattttttacttgattttgtagtgtgctcactactagctctctctctctctctctttattcaatatatttaagctccctcatctttggtgctaacataaacgcaattcacgaacacaaacactaaacataaacatacacatacacatacacataaacgtattacacaatgacatacactaacactacactaaaacgtaaacatacacataagcgcattacacgaacacataaacatgcacacatacgtaagttttgtgctcacacttatacaaacataaacacattacacaaacaaacatcactgatacagaaatctttcaatgtgcgactactcttgtttcaatctttgctgctcgatccaactactctatttgggttttcaaaacaaaactcagcaatttatgaaaatgaacacttatacgacgaaatcccacttcaactttagaaaactgagaacagattgtatttctgccagaagttgctcgttaaagacacaataaaattaaatacatatatatatatatatatatatatatatatatatatatatatatatatatatttttctcccagaaaagtaaatgaaaaactattcccaattccaattgtattgaatttttttgtcaatgattataatcgttttcaaagtatttcaatatctattgggtagaagttataacaaccgaccaagaacaaccaactattaattacgtgagcgtagatgtatcttgatatcattcaaagatctttcgtttggtattaatatacattgtttttgaacttcttgcagaactaaaacgataatactataatagtcactacactcaatagaatagagcccaaaatagtggtattcgtcgattttgaattacttgaataacaacttacaattataaacgacatggtttgcatgttgtacgttgatttggggaggtgtcaaataatcaaagtattatacatttatactagtagtagacaatattagcaaagacagcatttgaaaattcatatcaaaacgatttcttatgatcataaagaaaacaagatcttgattcaccggtgacattccatacccgaccaaaacaaggagtaaaaatagagaagtaatgttgcgtcgacttgcaagaaacaatagtgcaaactatatctgtatagtattcaattcaatatacagacgaaacaaaaacctattcaacatatatataaatgaataaaaaacctgagaatttataagtgggccaaagaaatcttaagaatcagagatgcgattttttgtccaaacaaagcaaatctaatgacttatttacttttgggttggacccacaagaagatttgatgttttactttctcttcttttctatataaacacaagcacacactattcgttaaagtcttcttctcttcttgttttgctctcaattctcaaaaactctctcttctaa

SEQ ID NO: 5018 - DNA, 1207 bp, Arabidopsis thaliana
tctaataaacccataccctagtaaaaaaagtaaataacacagaggtttgtcagaaagatttgagtttaaagaacaagatagcaaaacaaaacagaggaaaggtgttagaattttcattttttttgtcaccaatttgttcttaatttgtaaaaatttggtttggctgatgcattttcctctcagagcttgagctctatcaatatcgaacaaataatttccttattcttgtctctgtataatatatgataaaaaaagacattgaaatcttgatgtggcattaccataaagaattacgtttcattaatgttggttctgtcgtcttttaatataaaagtctttaacttgtgaatctgtcttatctacaagaaaatttaagactatatttattatgttaattacgatacttattttaatctatatttagtaaagcgaacaagtcctacaaacaaaccaaagatattgaaaaaaagtcactttggagatagaacagaatataaaaaagattctttaaatgatcttttatcaaaacaagattctaacaagtcttagaaatctcaaaacgaagaacaagtaagaagcttgtagccatgggtggtgatactttcaaagatggtaaattttttgatctttttctttgaactgtgtttgcatgtttgatttaacgaaaaataaattatttttaagatgttgtagatgaagaatcttcaagatcatcatcatcatctccttgttcttgttgtttcaggtatattattatttaatctttatcactaatttttgttgagtatgatcataatcataatcaagaaagtgatggtggttttttttttttttttttggtgtagcagtgatgatttagggtttaaggatgatgtttctgaagagaatttcaccaatttctctaatcatgttactgatttgagaaggagagaaaaagcttaccaagagattcttcaaagtcatgatcttttgcttagaaccagcaaacggaaacttagacaagccagaaatgagattttgaggtattttttatatatatttaaattcaattcatttagggaaaagttgtgtttgttctacttggtgatcatacaaactcaattatgtttttgactattattatggttgatatatgcatagctatactcctggatcatggtctgatgtcaagttgagtgattacaatattccaaaaacgacatcgatc

SEQ ID NO: 5019 - DNA, 1867 bp, Arabidopsis thaliana
gatgtttggtttctttatccacctaagatgtttggcttctttttcttatctcttgttgtttgattcttcaggaacttgttagaatcttttgtttcgtattccgtttttttgagatatatggttatttaaaacgcatcaagacttctaaaattgagtcaatcctttgatatatccgttctagaattcggtaatggagttgttccggtttagttatgcatcaaataatttaaaccgtagttctttattatagggatttgaactaattgaacgaattcattcaaaatattatttgaatgcttggatttattttataaaggaggttatgtaatgtagacatttagattgatggactaatatgaatgaatatgatgaaatgaaaataacgcctacagcccatttgacaagtttcagtgtcccttaatattttgttaataaatacatttacttttcttatttttgtcttctaactaaagaattttagtgtttataattatgctaattggttttgcacttaaagagtaggatttattcaaataatttcccgacataatccatgcgtgatatgtcctttcaatttcgtcttctcacccgttaatcaaatgggcccagcttttcaatccatttgctaatctgatcaaattttcctataacgcttacaaataacaatttgcaaaacatcgtcgtcgatcacaggaaaacttccctttagacatttatttcgccatctcggaagcttagacgttggaatatatatctattttcttaactaaccgctgatttttgtattttcattacaaaaaaaaaaactattgtaatgccatattcaaaatagtatatgctttggtacagtagaaataatatcaaccaattaggataaattttctttccattatataattagtctccctagcttagaggcaaatttgtagtttgtgttacgacgtgtacggactatatagcacctcaaagttgggccaatgagatgaaaatgggcctgggtccacatgcaagcagacaaaagaaatcgacgtgtcccatatgagtctcgtagcaagagtatgggagaaaccagagtcgtccattttttgggttcagtgactgtcattgtcagatatctatagctttgttggtaaaatttcacatgaaaaaattacataataaatagagaagagattttggaagagagaaaatgcaatttagctcctcacgtattagcaatttaagttcttgtcttggtcttccctcgatttcaaacgacattaaccaaaaccagagaactacgaattattcggtgagttctctcattgatacgatcctcttctatatatctccgtgttcttctagcttgaaagcattttaaaagtttttacttttggaggtttcacattctctccctgaacgattttgctttattttgttcagcttcggttctcgtcgaatcttctgtttctctgtcgattcattgatctgaaaatctaaaaatggattcattctgatttaacttttatcttgttcaaactcatttatgatcccaaatttgttcgtttcattctttataaattagaatccttttttgttcttgtggcaattatcttcctccttttctctgttttgaaagatttgttacctgcagaagttaattccattgatttcttgaagatgcagtatctcttgctacttaaaagagttagattttttgtctgatacgttaaaattatgagaggctcgttcgttctttaatctgtgtggtcaaagtttcctactttccgagaatttctttattgttgtgttgttcactttgcatttataatagtttttactaacgagctttacgattctgttcttgtctcattccagctaaaaaaag

SEQ ID NO: 5020 - DNA, 606 bp, Arabidopsis thaliana
gcagtgtggctcaaatactgcaccaacctaagcaaaaccgaaagaagaagggaagtatgatgcccattccactttggtgttttaatgagcatttcggtgtttgtcatgaaaccaagttttgaaatggcacttgtctacataagtgtaacagattcttaatttcaacaattttgttagataatttgtattcattctcacttagtgcttccgttgttctatcgttataaacgttttaagatatacgcatgtaactgaaagaagaaaagccattattgatccagtactgtagtgtcttagtgtgagcagaaaaaagatttgatcatggaatggctttagagtaaaatactaaaatagatggaatcgaaggcttatgaatctgacgtggaacaagaagaaagcgtatctgccacgtggcacaatacaacacctcaacagccttatctggacatcaacagagagatcctccaatatccgaaaccaaccaatcagcttcactcttggtttcacctccatacattaacacaccaacaatcctcaaaaaacactttcataacttaatcacacacaaggagagaagagagaaagagagaaagagagacagagata

SEQ ID NO: 5021 - DNA, 990 bp, Arabidopsis thaliana
gcaaaacaaaacaaaacgtctctaactttggtattatatggtctgttttgcaggttcctgtggggagactatgctcttggcttgaattgaatctatgggacattccttgtagctctcttcagttatctccgtaatggtgttgataataatatataaaaagaaaactaaattaatttactaggcgtggcttttttggttttaaattcctgaacctacatacatatttttacattagcgaagttactttcgtataattttatataaatttctttacatcgaattttaatgttaatttttttttgggtccaaaaccattaattggagtaataaatatattaaaagtttagagggcaaatcgggaaagaagatatttaagttgttttccttttcctacttggaataagcaaagtaaaacctaaaaaaaaaaaaagaccgtaagtagttacaagggtggaagtataaaggagcagtcttttcttcttctttcaaccccacggcgcagatcctacgagtttggtctttgtctctatcttttcaatctttctctctcaatcgctcttcaatttgataacagcaaaggtttgtttgaatctctcttctttttgtatgatttgtattttggatccccattgtgcttgcttttatagaagttataggttttgatattgtttgattcatgtttgcttcatcctaatacaatgctgattcgtaaaggatcggtttttgtacaaggatgatttagatgttctattactgcgacttggttatgttttggttacattaattgaatccttaggattatgcagttgactttacgaagatgaatgcttgatttgcttctgctctttctatctctcttggtgcttctatgtttttatcaccttttacgtgtttgttatgtgatctcagagacaacgagttcgattataaattgtaatctgttttttttttctaatgtcgatttcatatttttgttatgcttgtccagtc

SEQ ID NO: 5022 - DNA, 1355 bp, Arabidopsis thaliana
ttgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatagatttataatgaaagtttgacccctctctctttttttattgtctttttgttttgcttttgcctctctctcggggttttgacttttgtatcataaaactagaatataaaagtttacaaattatatttatctataaaatatttttattttatactttacgattgttattaagtaacgtcctcttaaattcgtcccgccaatctgtcccgtaaaaaaaactcactgattttatttatgatatgtttatgaatcattgtctaaatattttttaattttgtagtaattaaatgctatctaatatctctgcgatttgatgattataatcgaattattatagtcatgtagaaaaacaatatcaaaaatgataattttgtagtaattaaatgatattaaatatttcagaagttttattttagtaactaatcgtgtagttaatgtggagagattttgggaagattatcaaatatttaattcaaagattttctttctaattatcaaaaacaattattaaatgccagtggcagccactgtaaataaatctcaactctaggatttatttcacaaagtggctgcaaaaatgtatatataaatatctaatctttacttagatggcatgggtttgaaaagttctgagtaactgataggcccaatgactaaaagcccatatgtgtttctcatcataatggaaggcctacaagtagaagaattcgctcgtgtttatgaattatgatcttgattgtaatcttattatcaaaaaccaaccgtaaaagtatatgaattgcgtatttgtaaattgtaattattatatagtattgagattgtgattaaaagtaataatgaatttgttgaattattattatagactatagtatagtagcaagagtgaaattttgttttcaagaattgagtcctaattttataaaaggagccaaaaaacccaattctatctaatccaatgaaaactccaagatcgtctctacgtccgccacgtcagcactatcctgatcgggaaacccaaaacgagtggtcgaatagtttccgactggtaacagagaaagcatctccacaatccccaaaattctttcaacacttgctctccattaatcttttagataataaacctaattgtttctgttttgtttttgtttctgtgagattcttccgaggcttgaagctcaatagct

SEQ ID NO: 5023 - DNA, 2000 bp, Arabidopsis thaliana
aatccaattgtatttaaaattttaattataaagcacaccaaaaatatgatgtggtcaagctttatacaagggccctttcctttaaatatactttacaatgttttatttttggacaagatattatcacccataactttcctacctgatcaaaattatatcatattttaccatttcacttttcaatcaatgcctatatatccacatttgcaaaatgatgaatgtatatacaaaattgaagttgtggattgttttgttttagggaatctagtttacatatggagatgatgtcacttccaagagagttggtactatccaacgctctctcttgtttccaagatgtttcgtctatcggttgcatcacctgaactatacgcgagacggtcccttttagactgtcccgaatgctatatctatgttttcatgttgaacctcccagctaaactcagctggtatgttctcgaccggaaaacatcaggtcctagtacagctaagagctaacaatctcttggtggctgttcccttgctccacttacatagttatatgtctctacgttcaagcttagccgtcgttggttcaacaatctttgtcatgagtgcttgtctgtattgctcatggactgcccatctaacatgtgtgccacgcagatgactgtgtctagtagcatagaaaaaacttgtgtgtaccccttgattgtgtcgaataaaacagaaagctcaaagtttacatgaattactaaattgtttctctttaaaatccttaaactatgtaccatatatgcatatgggattaagataattactacgcaataatcgaagtctaattcagggagactaatccaagtaattcacaatcttgattaagagatcattggtagttagaagtttcagtgcataacagtttctcaattggtcaatgtatttactttattgtttcggtcatctccacaaggtcgtcaaaccatatacagatatactataaagtagtataacacaaccaattccataaatctcttttctcaatatgaaaaacgaactagattaactacaaatcaacaagagtttggattaaaacaaaaacaaaggagatttgggaaagaagaaagtttatcatcagagaggagtgatcggtacatcaatcggccacaaaaggcctcagacgaccgtcgtgagaattttagatcaaatctcatcacttgaatttaacttcttcacatcaaaaaatcgattactttagcaaagtaaaacaatatcaaagatgaaagctacaaaaacacgaagaaaaaagagacgaatatagccggcgattatgggtactgaagactagtttgcctttttatataggatgatggagcaaatctagggtttagtttgacaattaaagcatacgacaccgtttatttttaaatgggctcgtctatttatctacatgtctggcccatgtatgactttactagatctagttctgaaattgaaagttataaatttttgtatagattactttcttcttccttatttttaacacacaatttattatatgaaaacaatttaactacattaatgaaaaaaatacaattttttcaataatacaattttgcataacgtgctcccatatctctactctacaactgggaaaaaatatattataaagcttgtttttgtatagacatattcatgtgtatacaacatgtcaacaacatacattggcaatatatgcacatgcatgctccaagttgctaattaaacactgaatctgaaatctgaaattatgccaatctaaaaacctttcggcggtaaattttgagtgaataagacaatgtaaaatgactaagataaaaaagtgttaggtggggtgaaaaaaaacagagaataaaaacctcgcaagcgagggaagtgatgaataacagagacaattggttatattagctgtcactcccatctttcatattccttcaccatctctctctctctcgatcttgtgaaccactacacacactaacaca

SEQ ID NO: 5024 - DNA, 590 bp, Arabidopsis thaliana
cattttatgaaagaagcctacaaagagagaaatgtttgtttgttttttaattgtttttacacataccttgactcaattgtaatatatactacagaataatgtattgattaataaaagttaaaaaaaaactactcatattttattttacagataaaacaatcaaatctataacaacaaaaaaactctaattgtaatctgataaatatatacatatcattttataataattaaataaaatcatggaatattatttaatgtaatcatgaatacattcattatatatacatatatatatatatatatattttttaatttatttttgacgacaaaaaaatataaatgagtttataattacattaaatattaccccataattttttttttgttggtgaggccatgattttgttttactgtcagaaaattctagcaaaaaaaggaaaaatgtgttgcaggatataacacgtggcgaaatatgaatggatcggagaaagagagcagtgtagccacaagctaaatcctgaagtgatttctgaagataaagattgttcatatcaagtagttttcgttaattcactctacaaaggaaaata

SEQ ID NO: 5025 - DNA, 2000 bp, Arabidopsis thaliana
tttattgtatgattgttattatccaaaatttagcggtagctttaatatttctgctccaattctcattttagctgtgattatacaattgtggaaataatagcattacaagtagaggaactggtagatgcaactaaattataagtgtgaatcttagatgagtagatttatctctatcaacatgagaaccagcagaaacttaaaacattatttatgtaagatcaacttcatattttatggcagctgtgttgaattttcttatggccaagcattttaataaaacaaagagaaaattccaaaaattacactcagcttttcttatagtactaggttttatcttttggtgttgagattttttatgaaaatagaaaatgttttaagtgtttttatagaagtagatcaaagtttaatgctcttcgtacgttctatgtatttggactttaatataatcgataatcgtattcagattctttatagaaattacgctctctccaaactattggagaaagcttttaccattaggaattcgaaattttttgttccccaattttgaacatatgataagatcttttaaagaacactcgacaatgtaaaatttaaagtaggtctagcttcttatccgtttaagagaacgatttttttttttaaatgatatgattcacggtttgtaaagttatctattggaaaataaaaaaactgtaagtacaatactgtgatgtcaaaaagaaaaaaaaagtacacccaaactaaatttgtaccacgtgcgagacaaattgtagtctgcgatcttactcactacccgacaatgacatgccccatgccttagttcttgtaagaaaaaagtgatatcctatatacttcactaattattggtaaaattatgcaaaactttcagtgctaaaagtttgatttatactgtactagttgttatttcaacgtagacataccaaaatgtttattcaagaaagcctatatactagcaaaagtaaaaaagaatgtgacatctttgatgaaccaatgtgaaaagtcaacataataaaacttgagttttcagaacaaatttagttgtccattgtttcgatctgttaatcaagaccataaattaactcttaactatatgcatctaataataatattttgtagttagctaagttaagcacatccaactcttaaaaaaagctagtataacgttaggcttataatcattctcttaataataagttatcctaaacaaattattgcaattttttattctccctacttgcactaagtatcattacaccagtaaaagatgatgatcccttaaattaatactaattaaacaagcaattaaggaatgaagaaggtgagacgaaaccgcgtaaaagacctttcttctttgcaccatcctctctccttcatcatttcacaaatccacaaaagaatcaatctttttaacactctctaatgattcaacgaatccaattacccaaccagaaacagcaacacatatagagatatatactattaaacaataacataacaaagaaaccattttttctcttttgttattgacttaaacaaaaactatcaacgaataattatccttttttgagtttttcccatttcttcttcgtctccatttcatcgtcttctcgctgttctgctatattccggtactagatcctctgttttctcatgtttcttttattaccaaatgatttcttcatttattgttgtgtctttgattcttttttgggatctataatgatcgatgaacatttaaagctacgacttttcaggagctcttgtctttttttctttaatctttgattatgttacaaaacaattatgttttttgaagcttgatctgatgtgggttctttgatttcgttccaaagtttgatacttttttggcttctctttatctgattttttttgtgtatgtttgttcatgaaacagtttcgttggatgaggagaagaagaaagtgaaaaaagttgtgaaatagagagagtttgtttc

SEQ ID NO: 5026 - DNA, 2000 bp, Arabidopsis thaliana
gatggcaatataatatatacaaatatatatgtaacaattaatatagaaggtgaggttgatatatataattggtgtatatatatatatataagttcagtatatcaaatattatagaaaccaacccacccacccacctagtagccaccataaagaaactttcagaaaatcataattagctaaaattattccacatgctattggataaataaaagattatcgttgacagcatacttatttggaattcttctttccctcgattgatataatattacaatttcttacttcaaaattttaaataaaggacctgagcgagaggaaagaggctttgattgcatgagacacctattggtggcaagaaagtctaccaatcagagatcttaggttgtacgagtgaatataattataacacctaataaggattaattattgttatttcacttaattgtcttgatctatcttttaagttacagagcagtggggtccttaattggaacaactgtccaaaccaaatgccatttcattagacttatttgtattaaaataagattatcccatgacttgattcacctgaaaatagaataatctatacctttctttaatatcagttttctttctgtataaaatattgtcttctcatgctttatgaagatttgcccaagatcttgttttgaagattagacttatgaatataatttttatttgttaaatagtatagatgcttgcatcattgcccacttcttgtattccttcatttggcaactaactattctccctgtttaatgtaataagtaattaacattcattaaacatggtcaagataggctttttctttctttttcacagtaattagacaaataagatttggtttaggtggaagacattgagataaattacaagaaagcttcaattcatgctccatcatcaattctctctgcgagcaactttaattgatgggaaatttcaaaaatctacaatgataattacataaaaacacatcaataaaaagaatatccagtagactattaactttgttagagaacaagggacgacgattcgtttgatttcgttcttgttgcaatatgctcttgagtgaacgttttgatacaaaatgtcatctgctcgcttaaatttatgatggatatatgcgttattcaaatacatagtgaaatttaatatcattatgggatcaaaatattatacttaaccttccatgttgattatattttttggcctaagttggttagccttatttcttcatatctttctttgacttttgatattagatcaataatatgatattaacatcttaatgttctctttaagcttagaatataacttttgtattaattgtcacaagtggtgtgatcgctgcatgccttttcaaatatatttatttattcatcatatctcaacttaatctaactattttattcacgcactaaacagaaagtatttttccacaatatttaaaataaattaaatttgatcaattttaagtaaatgtagatataatagtataatacataagataaaagataaaacaagttgacaagttaagtctttatatatagtatttaaaagatttctctaacccgttttatcattttgccctttttctttcccatatatgcatatgcgcgtggtatccacatatatctctataaaacctattacatgttagtgtaatatttattgtacctatcaaggtttattttccaagatcatttctcgtcacaccttagattcaaacaactaattttattataaaccctaaaatactataacttgatgctgttcatgactaatataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatat

SEQ ID NO: 5027 - DNA, 2000 bp, Arabidopsis thaliana
tctatgcattttcagttttaatgggtccgattggtgaccaatttttacaaaaacaatagacaggaacaacatgtttctttttttttaccatttaacagtaatttttttctccaaattattatatgtggacctcacattattcttaatcgttccttattttttgaggaatcgtagaagaaaattgttctttcccaaatttgatgaggaataaacagaaaaaaaaattaaatatatattaattaaaaattaaatttttaacctccacgtttgtttgatattttttcttaacgtccatgtttatttaatatttaatttagaaaatattttatttattttttcatttttatactatttattttatgtttgggttatcatttacaataacatttattctatttttcttttacactcattcctttttatttttattttataattttttctttttctatttattcttttttaatcatgttcatttttactctttgtattttcttataggttaccaatcggatccaataaattgtgttttttttggctagaaaaacattatgttcagcaccatatgctacactttcacgacgaatttaaaggttctgtggacagaagacaagtcaaccgcaaagcaacccaagttcttgaaagatgcatgagtagaagattcataaatatttttttttttttttttttttaaatataatttgttctcgtcgatcttccaagtaataacattttcatatgaatcgtatctaaataaaattatgttaatcccgcaaattcaaacctacaatatatccactatttttcttctgtcaaaataaactatcggtacttatagatccggaatataacataagatgataaatatttacttttataataacgataagaaataataaaaagctacttttggtaataaaaaaaaatggtagtaggagatttcaaagttgacaataaagcggctcacttctatatttggaggaaaaagtataatggatccgattattaatacaaacctgtacaagtttttgaacgagtaaaaaatcataagtaattcaataatagttaaaaacagtataaaataggggtatgagtcacgaaaaaaattcgaatggtgaccgaatcgcacattaataaaattctctgcatatatatatatatatatttgttattatttgaactgcaccgcactttatccgcagttgaactgcatgtttccattaagactctgagagtaatatatatgataaagcttttatttattataatcaggctcgactcattagggtggagcgaaagtgcgacggtccaaaccttatgcctatttaaaaaaatttacataagaaaaagttttttattttttggaaaaaaaagttgtcaaaatataattgataaaatccccaaatttctttaaaatatatattaaaaggccctgattttatttctaaatgacttttatataccaaagagccaatatttttgtaaaatgttaaaacactcaagatatacttcaaaataattgcaaaagatgcccaaaaaaagttttacctaacaaaaggtccaaaaaaaagcaaacatttaccctaagactcaaatttatgttgggccgggtctggttattattaaaacgatcaaagctagtgttttgttaaaccgcaattttgtagcatttcatatgttaagatttgatggttgaaaggaaaacaaaaattgtgaataataatggttatgagatctaaaacatcaaaggaaaatcaagaagagaaaggtataaaatattgaataaataatatgaatgtggcagttatagtttgatgtagaataaaagattaaacaaaaatcaagagccccaccagccactccttcaaacgtgtcctaccaactctcttctagaagcaattaggctcaccttccacctccaacacctctctccccttctctctccataaaaccctcaacaacagaatcaaaagcatcatcatcatcagaagaagagagtc

SEQ ID NO: 5028 - DNA, 913 bp, Arabidopsis thaliana
gaactatctgttagagtttagttgaggccaataaaacttagcttacgctttattgatgttcaactagtattgttttggttattgatactctttggaccatatatgtaaaacagagcaacaatccactgtttgatgtgatcattgcatcgtgctattttgtatttgactatttggggatcagtcgtctattagcgttgcacatgcaatatcattatattgcttcttcttctttttttcaatcactaaaggatctagaaccagaaacaaaaagtccaaaattcaggttaatcattatagttttgctaattggaaacgtatgcaatgactaaacataaaatttatagtagaaacactagaaccctaattcttcaatttcaacataaatctttcaatttgagtggaatcattcaaaacttgattcccctaacttgaaagtaattatttgaatgtaagaattaaaaaaagcgtattttgtaaagtatcacgactaaaacatgctagttgagttaaaccttcataaaaaatgaaacatattatttgagtttcgagaaagaaaaaaaaaaaacattttatttgagttgtcgcagacacgatcacgatgtaccctatatatagttccaattagcattatttatcccatcaacaacaactattatgtcagaaatattgaattagtaaaagaaacaaatcttatctgggccatccatttgcacacagaccaatggacgtagagcgtggtaggcacgagccagatgtgaggtaccttgaggtgccacgtcacattgaggaatctttggcggggtttcattgtttacctataaaaatggcggccgcaaagtttcgtacgtctccgatgtttcaatcgtgaaatcgaaacaaacaaaataattaaaaaaagaaataagaggaggcg

SEQ ID NO: 5029 - DNA, 2000 bp, Arabidopsis thaliana
agtttttgactagcaaaaaacaaatatcgttcacatttgactgatacatcatacaccaaactgaaaagacagcattccccaaatcacgtatagaatcttaaatcatataaaatacattttgttctttgctttgaaatatcaaatgttagtgtgatttgtcgtcatgcaacgcatgcatataatattaatttattatttgatttggtaataagtctctttatacatgcattgaatccaccgaccaagtctactatatgctttgaaagtttgaattatataataatagaaaagattgttgtgaagagcaagctgaatcgatttggagaattggattccgatctggttttataattgttcgactacaataatgtcaaatgggatagcaagaaaataatgtataaaggttgaaattgcgcaacacctaacaaaagggagagaaagaaaacaccccaaaaacaaaaaggtagaggaagaaacacataaaagaggagtgaaagagaaagaagcataaaaagaaaggaatagaaatagagcaccaatcaatgacttcaaattcaattatttcgaaacaaatttttaaatttatagattactaaaaatcaacaaacttttatagaataaatttgtaaatctatgattcattagctaaacaactaatttttacacactaaaacaattcagagatgtgtacaaataaagacatgtgttaaataataataattatttgtaaaaaaatgagatataaaaaagtagatgcaaccaaattttttaaaaaaaacctttaaaatgccataaaaccattctaaaagtttataactgtatatatagatttgttattaattattttatatgttgctattcatttattaaatatcatctagttgttcaccataatccataatagggacaaaatcttaaatacatttcatatcaatttttttctttcttacaatctgccaagttaaagaaattcacaaattataaaagagaaataataaggtagtattaaaaatttaatactagtgactatcaatagatagtaacaaatactaatataagtatatattaattacgcgttatatataccttttaacaaaatatattattgttgttgactgatacagagagaaataaaaaaaaaaacagtttcgatttttgttattgcaacaaaaagtttcggaaaatagagagaaaagagagtgagtgaggttggtgatgaccagattttgaggcttatcaatagtacaaagcttgcaaaatcaatggcgcaaattctgttggtaagtataagaaaaaaaagaaaagctttttcctttagatgtcatgtaactgtcgggagagcactcacgtgtttctgtctcttcacctgtaaatattctcgccacgtttgctctctttctttttttccccgagaaaacgcaaagacaaagacgtttttttaatttggctatagcatgtggaggctatgggttcttatcttgtatcgtcgttctttgtcttcaatatctttaattcaatgataagcagatcatctctttcttcactcctacacatcgattcacgtcatccacccagaaaaattcatacttcaattaaaaattctgtaagtggaaaaaacacagttggcaaaatgggcaaaagctaataattgatttatctccatttatggctaaaagcctaacactaggctctacacttttcaagtcttttcattttctgggtaattgttgttcaattttagagatttagggtttttgattgttcttctttttctgggttttatctaaattcgtggatatgagaatggcatgtgcgtgaatgtggcctactttgttttcttccttctaatttgggaacagagtttggttgtcctatttattgttactttgtaggtttcactcttttcgacattacttttcaattgcttcagattcataaatctatcttcttctttctttggttgttcagctttagcgtgttaggctgaacatttaagaacc

SEQ ID NO: 5030 - DNA, 768 bp, Arabidopsis thaliana
gatctctctttaaccacgctccaagtggctatatttctcttcaacaaaaaaaaattgaaaagttttggaaggtagagtagttgaaatagatcaaaaatacatctttgaatcctgaaattccaatggcaaacttaccctttgctttataccaagatccgtattatccaaagaataatttgcttatataaaaaagaaaattcgttgacgaaaaaaaaaagaaaaaaaaaagaaaaaaagaaaagaaaattcggcttaaacttctagtagacaaagttaaataatctaggacaaaaattgcgactattcgagtttggtccgaaatcgtaagtaagagagtttggtcgggacgaaaaaaagaagaagagagtttggtccgaaaaaaaagttaattagagagtggaatattcgacccgcggaaaaaaaaatctttatccaatttaaatgcgtgtcgttttactagaaatatgaagcacttcttgttgtttcatcgtctggaaagtggaagcatattctctctcccatcaattattgagccaacccaactatggttaaatccagcacagttccaactaacccaggttataccggttgattacacgtggacggtggagatttttctgactgcttctctatcgcaatttgctattcctctgcttaaaaactagggttaggctacgattctgtttacaccaaaaaagcttttcgtcatcgccgtttggctttctgaaacaaatcacaccgtttaagattttctctgattctgagatt

SEQ ID NO: 5031 - DNA, 2000 bp, Arabidopsis thaliana
ggaataaaataaaataagagagagaaacatgtaatgaattaaagatatacgttttaaaatatatttagggcatctccaaccctactatattttagagtaaaaatgcaaaaatcttctccaaccctactctataattgattcaaaaatagagatttctgcagattgactctatatatagagcaactttattctctactctatttttgagttcaacttttttatttatactttaagtccctcaaatttaaactttttatttaatacatataattattttacaaacaataattacaacacataattttataaacttaacaaaatattaagtattaaatttaaaataattttataaacttaacaagaaacaagtacctaatttaaaataaacaacataagaaaactaaaacataaaattaactagtgatttaatagtccggtaaattgcatgtggatccgccaagatagtcaaaatattgtccaaatgaagtagatggaagaggagtttcttgatcttgatcttgtcgttggacacatcgtttttgtaaaatccgtccttgttcactctcaaagtatgcccgaacatgtgagttttgaaaggaattcaaatccaaaataaaatttgtaatgttttattatagttatatgatgtaatgggtttttaataaataagtagtgtttaatttaaataatattatattttttggaaatgtttacaaatctataatatatggggtcaaattgtaaattatataattaaaaggtattagtatataaattagaaatagaatatttctaaaaatattcttttttatagtagtaaatagatatagaactatacattggagatggtcttactatttgtaaaaaagtgagtttttttaattaaatagaatttcaatagtttacttattattcttgaactaagtttgtaaaatttctgtaaggttttaaattttaactgacttccaaattttaatagtcctatcatattactctaaataaaaatagtttatatatatcagacgaataggattaaactattatagatatcaagatcgtaaatttgtatcattaaagaaatgaaagcgactttctttgttatagatattagactcaacgaaaaaaatcgaggaaaactgaaacgagaagtttgggaaaatgttcaacaacatataatcgaaagaggtaaatcagacatatatagatttttttgtagtctcctagaaatcatgaataaatagaatatggattgggatctaattaccgaaacaaaaaattcatgaaaagaatgcaattggtcgtgaatcatggattttggaggtctactaggaatgtggtagctaaaataaatgatcgtattctattcaggtaactaagaagaagaatataggattaactgatctattaacgaatacaactttccatcaaaaggctcgtgtaacttccggttttgtatttataacatttcatataaactagttatgtaactagcaagtgattttaatctgattttgtataatgcttctggaaactcagttacgttccaaattaggttatattccaccgattttgtcaataattaacacttgacaaataaagaaaagaaaaaaaaaggtgtgaaatcgttttagtaatgacgtaatcactaatcagagcaaaacttgacacgtagatcgctccgtgtgacccacgacgaaagcttaggaatcgtaagctcactttttttttgttctctttcgtatttaagtttctacaagagcattaagctatctctcactctctctgcccagagagaaaaaacactaaacaaatagaaaataaaaaaacaactcataaaattttccattttctcacgattttcctcgtcttaaaaaaaatttctgagaaagaaaaaaaaattcaattttgtcgttttatttattttcctggtttcagaccaaaccagttagaaacaaactcgtttttttttcacaaatttggattttattgttccactgtga

SEQ ID NO: 5032 - DNA, 2000 bp, Arabidopsis thaliana
gtaattcttcaccaatatagtaatttcaactcatcatttcttaagagttcattatttactgcatattgttgtctgaatgcatagtaatatttgatttcagaatgaggcttctagatctaggtcacaaaacagaggagactgaaagactgattttattaagtctgtacggtactcagaaaacagaggatctagtttcttgccatataagttatctattctagtactttttcttttaatcttatataaatatcgaaagccatgaaatcatacattcgaaagatctattaaaggcttctttttaacttgggtggtcttttttttttttgggtggtctttgtttttcaagatatgttcgtcaatctctctccacaaaaatgttaagctctttttttctatctttgttgttttcagattttagattcttcaaatcgaaaccttctccgaaggtatgtgtcctcaatctttttcttatgtttgatcttctgatttatttttttaataatatgatggtcttttcattataaatttgctcttataattttgacctttcatcttatgtagttgcagattttacagtctattgatatgtggtccaatctcattaaccaaagaactcttcgtgggatcttccaaatcacttaaagaggccggagacaacgcatgcaaaatcacacacatacacacgtacataacatacatacaaatacacacacgaatacaaacatacatgcatgcatacaaacttacatacatacatacaaatatacatacatgcattcatacattcatacatgcatacatgcatacatgcatttatacattcaaacatacatacatatatacatgcattcatacatacatacatgcagtcatacattcatacatgcattcatgcattcatacattcagtcatacattcatacatgcattcatgcattcatacattcatacatacatacatgcattcatgcattcatacattcatacatacatgcattcatgcattcaaacatacatgtatgcatacatacatacgtacaatattgttaagtcttaactcaaacaatttatgtatagaataaataaataaaaatgtataaaagaccatttttgtatagaaacattgttggccgcgcactagttcacggacataggaagggaaatgataaaactcgattagataaggtggttttcttgtcttgaactcgattaaataacatgaattattgacttattgtcgtatagcctaaggtacgtatagagtcaccagctcgagcttatttgcttttgcattactttgagtaaaataatttccattgaaatatctataatttaatttaatgaagaggacccaacccatcttcatcttatctttaccatttatataaatccactgaaaatgggaatggacgtacgtgttctattgtgtttctaccaaatatttttgcgttttaatatctttcaactgtctctaccaaatctaaattggttagacttcaatatatattattcataaagttttgtcgtgtttcacgtgtttatgaaacgtacccgttcttgcatttagtcccacgcactatctttttttatccatacttgattactttctcaattcgtcgatctcacacatattatatccggccaagcggctaagtccaccataaaaacgaattatatcgataaccggaatgttatcagaaatttacaatgtaatatttctggaatgactattaactttgacgttgttacgagtttaataatttttgaaaagactatataactctcaaaacgtacatgtaatttttagcaatgtccttggagaaaacaagtgtaacaattacatgtacgtgtaaattaaaaataatgcaaatgtcagtcaatatttcgaggaaacaatatatttctgttcccatctctaatcatttcctcaatcatataccataaaaggcataaacagaaccaaccaaccaaccaaccaacaagaagaagaatccaaagac

SEQ ID NO: 5033 - DNA, 2000 bp, Arabidopsis thaliana
cagtgagagaaatttggattagtttggtgaatacaacagaggcaaaatgtaattgctatatgtttttttttctgtttttttccaaggaaaatgaagaaatgagtaaatctctcttgttattaatcgagttctcagtttcatgatttcgactataaccccctcatcacaagataaatttaaacctttacacgagcaaagttaatcataaattcaaagattggtagcttattgggaggttatataacactactaaatgatttgctatttttacttagagaagcataaaccattttctgtatcaaataaatgatattttcttttgaaataatagtgttaaggattttgaagaaataaaaattaatttagttacattgtacaatgtgattttcttcaggaattcttattttttaaaaattaagttaaacaattaaattcagagatactaattagttcatattgtagtttagagagaatacaattgtatttaaaccaacaaaactatgataagatttgttgggtcagatattggaaaaaggactaaaaattgtcatgatgttttgggccaatgattcactcttcggcccataaaggaacccatgaaaaatccagatcatcatagttatcccacgcgcatgtaaatcgcgttgttaaaagcgcccgtttttcgcagtctaacccctacggaaattggcctaaaatcaactgaatccaataatttggagtccaagggcgcgtgagctaatattctcttcttttctttctttatcgtttttttttttttttttgcttaaacgatatttcatgcctaattactctttaaaacctttttccctccaattttctttaaattactgatcattattttatttgtcgcaactaaatttttatctactgaaattagtaatggtattattctataaagctaaaccgtgtatgttaagagattggatagggttaatgcatgtggacacgttactcatttttcatttaaaaaaaagacatgtaatttgttgtcctcacgtctactatagtcgtaactcccgtaagtttatggctcacgtttctcttaaaatcattcattcttttggttataaaatactattgagaaatgataattgtaggataagtcccaaccccaccatcattttccttacaatatcatccgttgttttattgtaataaatcatcgatgtccatttttatattttatcgtagtgtgttcatgtttggatttgaaaatggaatatttatgacgacaacaacaacaacaaaagaagaaaatgaaatatattagtcaatattaactaaatgttctttcacatagacttatattgaaaaatataatatatgtccattttgatttttaaaaaagtaactacagtatatggaaagtagattaaaggattaacaaaaagaaaagataaagataaagcaatgaatgaactcattttttggagaagattggagattggaaggtttcggaggaaaaggtcggttttaacaggggagcttttcttattgctcagagtgttgttaaaggagataggtttcaatcttatgcggcggttggacatccttggtggctccatcaactatttgagggtgagagaatctcttcctaggccttgtttctttgttttggtttgtttgaccattgtcaatcttcggtccttttggggaatggttgtttgcacgactattcttgtaaccttaattggtctttttgtaaaggttctgtatctcaaacaatattcatcaatatatcattatattggagaaaaaaaaaaaaaaaagataaagcaatgaatgaaagacaaaggcaaaagggtaaaaatggaattttgagggataaatgaaagtaaggcaaatgtccatttcattgatcttttcttataatatcatattttttctttcattttggaatctttctctctctctctctctaaaaccagattcttaatagaagaagaagaagaagaagaggaaaggagaaatctgcc

SEQ ID NO: 5034 - DNA, 2000 bp, Arabidopsis thaliana
tattaatttttatatcttattatttattactggtatcgtaagaccaatctctttaacacatcgccaaaaaaaatgtataagagctacattatcagttggcttggattttccttttttctgccttcatcactttgcgcgttaattccttctataatcgtcctcaaatatttttaaattgctatgtgctgaatattttaaattttcataaactttaaagcaacctaataattttctatttctttcaatatatttattgtttttcctatttaccaatttaaataaaatataattttaatacataatatacattaaaaattgaacctcttgctctttcagaagaaaaaaaacaaaaagcaaaaaccctagaattaaatagtactgtcaagttggagtgggtacaggcacgatcgagcaaaacgaaatgtcccatgcatgcctttaattgctttagagttagttcttccaaatcaagaattagttttagttatcaataaataggagtacccactagtagtcgtaccacgacctttcaattcataggacaaacgtcttaccccctgcattattatgcgatatatatgtgaatcatacatcatacatggtgcctaaagaaaatgtgaatcatacatatgaatcttaattattccatacatttaaattatgaaatgcataaaaatgttttcgaaaatgattttataaacatatacgcagaatctcaaagttgctaattgtatactattgctttggtttggttgttaggctaacgtcccatgatccttcggaaagataaatatgcatgacccggagtgatggagcatctaaaattttatggaagctttgctcttaaaaagattaagctgtaattgtataagtatatatagttttaaccaacttgtggttatttttgtagtcgtcgaaatatttattatgggattggaagatcatggtggattgatatgtgtgtcttttctatatatttttaatatttaggtcccattaaatcagtttgtgatttcagaatcctaacatacccttttgagattacttttcctatttatctcgaacataacctcattctaaaactacaacactctattgggacaattctatttggatcaaatttgtgctatagtcatgaatttattactcaaaattaactaaaaagaaatgaacgacacatattttaaatgttttctaggtttaatatcaacttcagatgtggaatattccaaacatgttcgagtttttctattgcaatttcaataataattgatcattgtggacgttttaaatcactagaacattttggcctctcacatgtttcatgattagtctttattttatatacagaattccggattatgagagaaaaaaacacatacttttattaataattacaaatttaaattgaaaatttatttttatgttattacatccaatgaactaatgtcaatgcatggaaagaattacttaggctccgggaacaacaacatgatcccttcacacacatactctaattcaactaaccaagtcttcttaattctgataagtcaaattgaaaatgtcattaccactgattaaaaaggaatcaaaagaaaaaaagcttttagtattgagtattgaccgtcgctatcggtgacaggcagagtcacaagccaaataaaagggaaccgcgtggtacgtacgggctgacgcctagctgctacggtcatgacaataaattgcccaatcaaagtaacatgccaacgtggcgcagacatatcagtcccacatgtctgcccaaaactagccaaagattacgtgaccgcggtccctcttgtcccctgtctcggtctaacgataacaaaccgagcccacttttatgtcgacgtggaatttggctgacgttggttttctccttcttgccactataaatacaaccccatactcgtcgagtttcaatatctcctcatcatcaaacacaaagtctaatattatcacttacaaataccattttaatc

SEQ ID NO: 5035 - DNA, 371 bp, Arabidopsis thaliana
aaagaaaagagaaatgctcaacattagacgaagtcctatataagaataaaaaacttatgaagaaaaattacattttctacagtcaagagaaaataatggtttgtatcatagtgtatatcttctatctgtttttcctctatatatttttgtatacttctgtttaatctttctcttatctaagttgttattgtgagcaatgtttgacctctcgaagcttatcctcacacggacaataaatgacatgtgaatttatatctattgaccctgacttattttgccgtggtaaagacgtctttaactctgtttttttatagtctgaatgttactcttatcaccaaaaacagaacacaaaacagaggaaaacaaaaact

SEQ ID NO: 5036 - DNA, 2000 bp, Arabidopsis thaliana
tttagtctttccgggtcgggtttttatatagccactaattgggcccattatctttcggacttgccttttcttagtggatctgaagaatgcaaaaaaaaaaaacaacgtcgacaaatgaaataacaagcatagtaaataattaaatatataagatttcgaatgtttacggttgtgttgacgtcaaaaaagaaaacatttatatgataagtatttgggttaaatatatagtctatataagttttggttgaatcaatgtttagtttagacaaatcttgtattgtatatcgttacatgtaatttagcttaggtcatgaatttaatgtagttgcttctatcgccaacccttttggccaagaaatccggcaaaaataaaaagtgcttaacatgtagtatagcaatcacaacaatctctagaaactaattgagtgattggttgagataaatctaataagtgaaagaaattaaccatagaaacaagctattggtgatgaacggagtagctatctaaaatatgactacactataaatcgacacaatattcgagaaaacaatcattatccaacatatatatatatatatatatatatatatatgaattcgaaattcgtatgtacagattatgttctacgcgaaagtgtcaaatgtttagtaagaaatcgggttttaatccatataatagatatcaaggtaagattatactgttgcggtgattattatatcggtgaggatagaatattgtggctgtgactttgtaacgttaaaagtttaagacaagagaggaaagtttatgagcaagtagggtaggatatatagatgaaataaacgtgagaaatgaatatgtggatgcaatttcagtttgttgtgtggggcttgtttaatactatacagtatacttatatcgtcattgatttatatagtacacctataatagagctatcaacatcacactataaatatttaccctaccatgcattagttgattcctctatctgcgattagtggaaaattttggtattttattgcgatgtatatgaatagggtacaatgttgtcatggtagtattagtttattaccaatcacatatccagcttaggaaatgattataaagctatgcattcatacttggactaacaaatagtttagtttgtttttttttcatttttaaggattaatttggtgattcaaaatggatgaggatctagcggaagttggcactttgcggtgatgaaggaggacgtgaatgggacgacgatgtaaacagtatatgaaaaatattataacaaaatttctttgtgaaacaaaattgttttgttcctctgttcattacaatcatggatgtctccatctgacaacttgtaatatgctagtattattggactcttatcaaaatcatctattgctttatttgttagaacctctcgtctcgtgacatatcgtccagaatgataacatgcagccaggatgctcttgagatctctaatatattttgggttagtttggctatttctcttctaatatgacttaaattacaaattatggggattggtttggccttgtaaaatgttttccttctcatattctttttgaaggaaaagtaaagggaacagaaaaaggtcaatcatgatttagttacaacttacaagtataactaaattattggaatcaacaaaaacgtgttccaaattgtatcaataaatagacatagttgatagttccttaatttcattctgaataagatcaagaatttacaggttctctcttctctctctctcaagttctgatttgtttatacaaattacaactttagtttcgtaaataggtactcattagttgatcattgctctctatgtcttgctatgcaattcaataggctagtgtatcaccaatcacagatccgggatcccggcttagtaaacattataaagcttgaatatacactttatttggatttggataatttagttaaaaaattcattttacagtatttgaaaaaatacaaa

SEQ ID NO: 5037 - DNA, 1275 bp, Arabidopsis thaliana
aatgaaaaagacgtttttgtgaattcttattggtatttgtagcgtaatttgaacgttcttggcatttggcaatgtatgtttgttgtctattctattcatttgcatgacgtgaagaaaaagttattttgaacatcattgtattagtctcttgctactttttgttaccattttatctccatttgtagaaagtagaaactccaattcgataaaataaaatatacacatttctatcttcctgttgtatatgaaaaaaagctggcatgagtctccaaccaatgagacaatttaaattatggattgacatgtaatcattaatcaaaatcattgttcactgaatataataattttctctcatcccacaagtagaagatataaatatttagtactaactataattcattctaatcattttacacttagagacatagtctctcagctaaataaaaattgcatgtttgtaaccatttccctgaacttatattaaaataaacacatcatgatctattaaaaaaacacatcatattcttggtctgccttaaatatattggtaataaatagtggtaaagttaacaattaggttggataattcattaaactaatcaatattgattaagcaactattcatgtctcctagtaattgtcacatcgtcgtttggatgattctaagtttctaacttaacccaaatgctacttcaatagactttgcattttaaaaagtcaatgaagtaagcatagtcttgatctttgttatcattataaattcaaaagtatttacatatgatgtgtccggataaaaattgaaacttgtggacttaaacttaagccacccatacctttttaacgttttgccacttgattaatcttcaagattagagctttgaataaaaatgataggatctcacgattgccttacattctaagaaaacgttaatacttttttttttttttctcgtaaatcattttaaaattgagagaagagaaaatgaaagaaagagaagtttgttgaatcagtagttgcagagacatggttagttccgctgactctgtcaagtcatctctttctctcccgtttactttacgctcacatctctttttctccacaaggacaaaaaacagagtcattcattttttctctcaaactctgtttaagaaaaatcgaaaaaaatcattactttccgatttgctttctcactttctcatgcaacaaacgtaaaacccacaaaagaaattcgaagcacaagttttgaaactctgtttttttattgatcagaaaca

SEQ ID NO: 5038 - DNA, 1476 bp, Arabidopsis thaliana
cgactgcagaaatagttgtaagatactaagatcacaattcttataaaatccgtaacgtcgtaagacttatctatcttattcttggccgtaacagtttctaaaggtaccactcaaagacttttcgtagtcctttgctatggctacaagactacaatacatacacctataggagccagtaccgggtaagtaaaatggctcacttttttatctttgctagctctgtctgaatactagtacttttattacatccgttcctgttaaagtgtttagcatctgaactttaatcaataaagatcggtaccaagactttttttgatgtttgcagtaacaccaaactgcatcgtgaaaacgtttggtagattgattgataagtttgagggttaagcacaataaatgaccacacttgtttttcttttggttgatagttacgggtttttgggtttctttgatcttaagcaaaaatgacaagctaacaaaacccatgtgaaatggctttgcatttataaattcttgtattcttacttatgttatccggatttaaaaatcatctacatcacacattatcttaagtaaaagattttacccgcaatttgtgacaaatcgaagaatttgccatttctacttgcaaattgatgcaaaattcatgttatgaatatatttcaaaatttatctacataaagacatattttgttataaaaaaaaacatacgaaacatatattccttctcaaaacaaaatcctattagctaactctagtaccaaaacatttcaacatttacccaaattggatacctaaataaagttgtagatacacgtcatcaatttgatcataacgttatcggtaggtctctgctgtctctgtcacaatcttaggtatcgttaaaagataaatattaagtggacaactttaacgaaaaaacacaaaaaagttgattggacaacgttactatccagtttttagcgtgttatccaacccatagaaaatttatctctctgtattcccataatcctcgtagattttggtcatcactagtcatttatttacaaaaataggttaaaaatgtcattgcgtaaaaaaaaaagaagacttaatcttacattatttcccttttaattattaaaatccgccgagaaaagtttcaccatcaatgcgtaactgaaaatcgacgaatcaaagctataatacacttaaacggatcatcatcatcatcatcgttgtcatgatcatcactgccgtatttatagaaaccaacaaaaacatgaaagagcccactcatttttcctatttttcgctttgcgtgccttcttatcaacttgtaaacaaagctacaaatatctttaaataaggacccaactctttttcaattcctcccatcaatcttcttcatttgttcttctgttggtggtggtgatctagttttcaaagaatcgattttgccaagtgggttcttcttgataacctttcttcttctttgaa

SEQ ID NO: 5039 - DNA, 2000 bp, Arabidopsis thaliana
tcccgtagctcagttggttagagcgttggtcttatgagccgaaggtcgcgggttcgagccccgccggaagcatttttgttttgttttccacaaggcccattttgaagctcaatttcaatttaacaaagcctaactctaacatgtaaacgttttcttctcggtagatatgtttcgcattcttataaatggtcggcgaaaattttcaaaatgtttactttttttctttccttgcatctcgacacgtggccccggttcatcctgtaatctttttggaatattccgatatcatatatgtgtatgcatgtatgtatgtatatttgatttctctaattacaaaactacccctactttgtcgtgtttcttactgtccccacttcacagctttgtccaaatattcaaaatgacccatccttctttaattattaatattcggttctttctttcgattaatttaagaactaattataaactatatatatatatataaatatttggctggaaatgtgattatatttatggctgttggttgttgaactagatactcataattttatagcagacaattgtatgacatttaggaagtaattattggacctatgtaagaagttgttcatttaacaaaagcacagattagaaaaaaactgccaaaatgtgatgtaatcaataaaaaataaagttcaatttagtccatttagctaagcaactttgacattgcgagtattgacttctttatttaaaaagttaggaagaaaatggttctgcgaatgtagctactaaaaagaatcaataattcccactaaaataaatgaaaaattctttagattagagtggcataattgctaaattatttatggttaatacataatatgtcagtccaacctataacaacttagtagataaaaaaaaagcagagaagaaaaacgtttaagtaggtataaaaatacgaataaagtgggagggggggggggcaaaagaagtttgaatggtcaaaactcgaaaaagaggaaaaaccaaacccaatgtactttcaaactccaatttactaactcccaagccaacactatctaatctatccccttttttattttattttatttttagatttaattttacgatatgactgtcaacagcgcattatagcaaacgccactcttctcatcaaaaagcagagccacatacattaacattacattagcttcctcatttttattcttattattattattcatcagaccaacaacaaaaaggagataaagagaagaggattcatcatcatcaatcaatccttcattttatggatctactcatatcttgattcttccttctatctctcccttttcttccatctctttttctctgggtttccccggtatgtttcagcaatctcttttttgggtcttcttttaaattctgggtccttcaaagttttgcatacaaaaaaattgtttctttttggtattttagtctcaaatccgatttcatgttagatttttcctctgtttagatcggcctagatttgtttattggccaatatgagatagatagatttctcaatgctctgtgtttttaacatctcttatcttttgttgtttgtgttgaaatttgctatcctctatggattgttccatgatttttttcttatttaggatgctataattttaaattttttggctgtctcctgctttttttttcgtgataattgttttaaatgtctcgttaaaatccaaacttttgcatgttgatagcttcaatatgagttctgggatcacctttattgagtttcaaatctgtgtaattgcctcagttaaactgattgtcttgtaacaaccaagtaattgtaattacatatgtatggtttatgaatcaagagctaacgcttactttgcttatggttaatgttgctgcaggattgagttttttaatctctgattgacagatttgaagagcgtgacaaaggaagaatcttttattaaaacaaattcttctgttttaatcttggg

SEQ ID NO: 5040 - DNA, 877 bp, Arabidopsis thaliana
gatgtattgtttcttcttcttcattttggtgttgaatcatatgtaaaataatcagtttactactctttgctttttgggctttgacgataaactaacaacacagctttgattttctggttaatctgtttcgtattagacagactttgtaaactttaaatgttgctcaaatgcttgcttgtttagtatacacactttgaactactctttctatttcaagactaatgtactctgttattttgtaaagtacttgttatattattagcttgagcacatataaaaaaatatatatatattatattttatagttttttttagattcgttaattattaatattatagattattaagttccaacaagagtgatattatttcatttagcaagctatttcttaaaacccactatatttgctgagatttgtgtatcttttattctttttaattaactataaaaaatgtaaaagaaaaatatattttctgtttatttagtgtttatttaatattataatataataattcctatgacacaggtttaaaacaaataaaatcccagtaaaaataatttttgggattataatttaatactaaacaagaaaatctatgatgtatttgctaaaaatacaaagtttaaaaaactaatttttttatatacattaaaaaaacataattttaatatttagttaaatagagtttggccaataaaaatatttactgtagttacaaagtatataaatttaaaatagttttaatgattttattttattttttgtttataacattttatattgtgaaacaaaataaacatcctaatatgaaacagaatgacacttccaaagatatgcccaattgaagcaaaagccagaacagcttttaaattgca

SEQ ID NO: 5041 - DNA, 2000 bp, Arabidopsis thaliana
agaaatagaaaatatataaaagttatactcttgtaagcaaagaaaagcccaaacgaagcaaaacaagacaaaaagcccagtttaaagtagatgtaagcagatttacttgctacatcatcaactccccattttacatcgtcccaatgagatatatccactcttttcatagaatttgatgttttcacacgaatacgaaatcccaaatatataatctatcccttataattcataattatatacaaaaaatatgcaatcacacaactagccattaaatactatatagaaatatcaccacttgtcatttcaaaacaatacactaattaatgtctataattcaatccttgtcagatggagataagagagacacaatccataattttgttgctcattcatatagttcaagtgcgttggctcacggcaaacattttaaatttagacccacgccggagaaaatctaattagacgcatagtttattatagtggatttcattgggacaaacaatattagccgcattttatgtaatatctttcacttggaacacgtgccccatacacatatggtccctccatgctttgtacttatgtagttttttgtatgctacgatttggtattattgtatcgcaacgcgtaaaaaaggagagccaagtgtgtctccaatctttgggattgatttaagaataaaagataggaaagacaattatatgtccaatctttaagattgatgatttaaaattttgtagttatcatgaaaaacaaatttttatagtgttgtagggacgtaggtgatcattctcatgactcatgacacccattccatttaccaaatgcattacttatttacttgttttggtacaataccaaacacactaacaatgatttaacatttacttaattataatataaatttgcttacgaaacaacttgcattaaacaatttgcttctactatacttatattgatctatcgtgggcggtgagtaaaatgagttgggacatggatttgtcatttaggtcatttttagtaaatgtgaaacttgtaaccaaaatatgcataaaaactttagcctttctaaaagctaaaaatggtttgaggaacaccaagacgtaagctcttttaagctatttgatgtttgatgtgataaaataactaaaaactatttgttatgttttttcctccccttaaagatataagagaagagaaggtaaagaagttgtgtaagttagtcacaatcaattgttggaaataaatttgaaaactctgttaaaagtcacccaaatgagtttcaaacaagagttaaaagattaaaaaaaaaaagtaactgatataaagaatggtagtttactttttttttaaagaatggtagttttttaaaaactatttaggttgatggtatttttgtaaagaaatccaaaaattgtagttgatacaagaaaattttgatttgtgttgatttatttctcttttggcatgtgaatgtaagtaatctttttccacatgatttctaattctggacttgcatgtcttgttacgccagtcaacattcgttggataagttacaatgtcatttacaacttgcagattaattcggaaatcaagaaggaaaaaatctgaattagaaatagtaggttggatttttcacaaaaaaaaaaaaagtacaatattttgagatatgaccattagattcttaaattttacgattctaacttgtaagatttcaaattaaaccatgtataattcaatttaggggtaatttaatactttagggtagtaacgataaaatagataattaaattgaagtttaaggaccatcctgtaaattcaagttcggtaccggaaacacgtcagcattgatctaatagatacgagtcctcctttctctataaataacgtaatctctctcccgtcttcattaccatcgaaacagtgtcgtcgtagtctctctctctctccgcaaaatatcatcggagaaaagaaacagagacacgaaacagagaaaacc

SEQ ID NO: 5042 - DNA, 729 bp, Arabidopsis thaliana
ttcacacgcgctttttgaaggaacctgaagttgcgtgtgagggaagggttcgtgacttttgttttgtgcgttttttttttgtaagttaggcttggaccggtttaataaacctgatgtaataattcggtttggaaaattgatttctctaagcgtagactttaacccaaaagggtggtctcgtggcttttgatttgtcaattgtgtgttttcttttaattgtataaagtttctatgaatatatttagtttattcgagaacaattgtatgaaatgtttagttaatgttttcatggtatataggttgtaaaacaggttaattacgttacaatttcctagttttggtattaatatgcaaaaatgacataatatcaaacttttaagtaaattgatatttttcactaatgttaataatgaaaccaactaacaaaaaaaaaaaagaacaaaccaatttctatttgtttaagactttgacagtacatcacttttagaaataaatgccataattatgttatgtgcacactgcaaaagaaaatgaatacgcacaattgactataaagaaaacgcctttagtggccatacgatttttagcattttatgcggaagaaacaaagtgctatttctccgagttacgtatgtttcttttcttctgcatctagttttttttttgcatattcatcaccttctctcagttttcttctttcaatagaattatccagaaaacttttaagag

SEQ ID NO: 5043 - DNA, 2000 bp, Arabidopsis thaliana
taatgaggcgctagatgagcaagacgacgttgaagacggtaaaacagatgaagatgaataggagggggacaacgaaaatggtgatgggtatgatgattatcagggtgactatggatctatgggagaagtaccctcgatcctactatcgatggtagtgaaagtagtggcgaagattatgattacaacaagtggaacgatgtaattgtagaagaatatggaatagggaatgttgaggaggacttcattttcactcaactgactgttcaacgtccaggggaattcagtcggctgttggcagcgtgtacgtacacaagtcagcgtgtacctaacaaagataacatttctcactcgggtgaccgtacaccagctgtgactccaagaagtacgtgtcaacatggtttgtaccaatgtacgtacactatagattgaggagtatttttaagaacagaaaagtcatacaacaaacaatgtcttatctcgcaatcaaacaatgtttttgctataagcaacctaggtcatgtcctacaagattggagatagtatgcgttgatgatacctgtccatgacatttgactgctcaagtcgtcaggaattcagaatgtttcaaaatcacatcgtatgaaagtcttagaatatatctcagtcattgtcaatatcggtttattattgaatcaataaatttttcttaataatttaattcacaaacaaagatgtacgtatattactacacatgtacatacattaatttaccaacaaaaatgtacgtacattattgcacatatacgtacataatttttcaatatgaggaacaaatattatttcaccatatatttttatttaattattatgtatgtatggagattattgagatataagaatatgtaataaaatagcttaagttattagaaatcgtaccatatacgttccactaaataagttcgtgtacgtacattgtaaattgaatatacgtacacaaaagaaattcgatgaaggttataactgtaatttttcagtcatcttcaacctctgtatccttttttgcaaacctaattttgcggccgtctttaccagttttttcaaaatctcattttttttttcattttgaatactttttacaaataaatcttgtaaacctagagtatttttagttttaaaagctaaagtgtttgaatttttggttttttttgtattttgttcatctctgaaaacatgaaatttgtttctcaattttaaagttcaataggatgcctcaaatcaattacccaacaatttgaacggtaatgtcgaaaaatgaaggagtggatgaatgaatttcgaaattatttctacttttctctcggatctctccgtctctttctcgttttcttcgtttcagttttttttttttttttcgcaaaaccaaactgcaaaaaaaactaaaccaaaaccaactgcaactgtgcgattggttgattctattaagggtatttcagtcacaaaatgtttcaaaagggaaaacgtgaaaaccaactctcatttatccaaacgatgagagcaaaaaaaatttcatccacttttgtgaaaatttcttaatttttaataagtcatgaaagttgaaaccatttttggtcacctaatttgactttcacttgtcctttgatccttgacagtatatgaaacccgtactaggccttgactcgtttcatattcattcccttgtagtttccaaactatttggaagcggaaacgacgtcgctctttccagtgttactatcgaagacatttacatgccacttaaggcataatgacaacgaagtgttcgacgtatcgtttacgtaagcgcaatttagggaagaaaagtctttttgccttgctccttacgtcaccctaaaagtcaagtgttcgtgatagaaaagtctcttcgtatttgatccacaattctccaagagaataaatacaaatcaaaatctgtttatttaaagccaaacaataggttttaataaggaaacgttaatagataa

SEQ ID NO: 5044 - DNA, 2000 bp, Arabidopsis thaliana
aaaaaagaagaataataactatctatttataaagaaaaagctccacgtcgtacgtgattagctcaaaagataagttatcatattgatagggaatttcattttaaaaagttattatcatattttgtaattattaatttacgagtatcgtctttgggataggatgtttgtgatcttgggggcatagaaaaaaacagtagaatttcgagagctctagcatcattgatgaatgtacctgctcgagtttataattttagaccattgtcaattatcatcgtgaaaagattattaaaacatgaatgtaatatttcattctcggattgtattaataaatatataatatgtttcattttatgagtaattttgtactatacataattcagttaatgatcaattgcggaaaattctaaatttttatataatgagaaacttatttacaattttaaaacttatttaacattcgtatatatgagttgaacaaatgcaccatgtgtgtgtgaacaaatttgcagtaccatgtaaaactaattagcttaccaagatggactacaagtgtttttggtcgggctagaagtaaatgggttggaaactggtcatagatatgggtaaacgaccagcggctgtgctcttttaaccatctcctaaattactttaatccaaagccaatattttttgatcattctcattaaaatggttggttttccagtgaattttgaagttaaggtatatctgtagatagtcaagtagctagattaatcattgggtaacacttaggtggtccgagaccattttgggtagctccaatgtacatctcttgaattccatcgatccaaagggtcgtttggtttcatcattctccttaaaatgatgtactctctgaaaagaaaaaaaataggttaacgtcgttaggtcgaatggatttttcaatgggtaagtaagtatttttgattttggtatggttcggataaattcacgtttatccggctaaatggctcgaacattttgaattccacccaaatggttaatcaacttcttaggaaaaccttttgagtgaatatccaagcctctatttaatcgatcagatctaggattggacaaggatatcctccttgtatttggtttttggtgggactaattaggtaactccttggtccatgtaaaatttttagaagccacaattgaaacgtaagaaaggcactaataatcacgggcatgccatcatcacccatatacagtataatatttatataagattttttacacatattaacaaaacacaaaaatctcatttaaattatttcctttctataaaaacattattaattacacctaatttaattaataaaaaatatgtaacaaaatataattgatcaaaaatattaaatatatttaatttttgtatagaaaaatgaaaacaacatttattttacaacaacaaaacaaatcattaaactacatgaaaacacaaaaataataaaattgctaaacaataaatgttatctaagaaaactataattgtatacaaaagctagctattacacttagcaccatataaataaacttcttatccatcaatgtttaatatatatttgtatagtaaaataaaactagtttgcatctgaaaaagtataatcaaataaaactctttagatagcaatatgtacattaaaaaaagacttattttcatacgtattaagctgtaaaaaataatgattaagatttggggtaaagagaaaccaaagtttaagacggaaacgaaacaaaagatgataatcatcgattcatcatcacgatataatatgggttgctaaccacaatagaaaaacaaaagttcttttaaggttttaataatatatcaccaaaaatgataattaaaacctaaaattaaaataatatatctacaagactacaacaattctgctttataataaagctataaacctcaacatttttcaacctcttcccaaaaaaaagtgtagaagcagaagaaacccatcatcatc

SEQ ID NO: 5045 - DNA, 2000 bp, Arabidopsis thaliana
tatttctattactatgctaactgtctaattatgttgattctaaataattttgcaggatctagaagacacaactagtgccaacatcacttgtacaagacaccacaagttttcaaagccaccacttagtttgtttgtttttttgtgcattggtttgaataattgtacatcacaaaactatattccgatattacaccacttgtattcattgttcgttacactttgtgtttatatatatagtacataatctttattacaacaaacaatacaattctctctattattctctaaaacaatcttccttttctccaaaaaaatatttcttttctccaaaacaatcttccttttcaccaaacaatcttctttttctccaaacatttatcttcatagttcatcaaacatgagatcttcttcatcttataatcttgacgataagtttgatcaatttttcaatgaaacattatagagatatgttgatcgtcaaccaaccaagtcaacaaaaatgagcatatattgcaagagatcgtgaactaggacacatccagttgtagaacgattatttcaaagaagatgcgacattccctcctcatatattgtgacaccgatttagaatgaacaagccattgtttatacgtattgttgacggactctccaatgaaatttcatgctttgaacaaagaagagatgttatcggcaggttaggtttatcggcactacgaagtgtacaacaacaattcatatgattgcatatggttgttcagtggatgcggttgacgaatacctacagattgtgaaagcacttcgatatcatgtatgatacattttgttgaatgaattatatatttgtttgggaaagagtatctaagtagacctacacgacaagatcttaaacgactactccgtattggagaggtacatgaattttttgggatgataggaagcatcgattgtatgcactggaagtggaagaattgccccaccttttggaaaggataatatacacgtgtatctggcaaaccggcaatagtgttaaaggctattgctttccaagatctttggatatgacatactttttttggacctccagatttcttaaatgatatatatacttgattgcttaccagtttttgatgataaattacaaggtcgagctccaaaagtgaaatatatcgtcaactggacctactatcatttggtttattatctcactgatagaatttatcctaaatgggctacatttatccaatctatttcaattccacaaggtcacaaagattctttatttgttacaaattaagaagcttgttgtcaaaatggttaacgtgctttgggagttttgcaaacttggtttgtaattgtcaatccagctcttatttgggataagaaaaaaataggaatgatcatgcgagcatgcataatacttcccaatatgatagtagaggatgaacaagataagtacattcagtttgatgcagctgaattcacacaaccaaaatcaaccagctctttacaaatggatttcaactattttacagatatgctttcaaatctcggcaatattatggccgctcgagcccgagttcgtgatctggctatacatccacaattgaaagctaatttggttaagcatatataacaaacatttggcgggaattaagctaacaattaatcgttattctgattttcgattttcgtattttatatatgcttttatgtcatgtatctttaaaattggtgtatttgcaataactattcagttttataaaataaaatatttataatttttattttaataataatttttttttaaaagcccacttttttcattagacaaaaaaaatttaacaatctatccaaaactcttaaatttgaatttgataaaatttataattaaaagatttggaagagccccataaaaagctcttggacttgcttttagttttaaaattgttaaggctaaatatcttttttttttttgtcaaccatgtacatatatcttggtg

SEQ ID NO: 5046 - DNA, 2000 bp, Arabidopsis thaliana
tcggttttaatggtttgtgttttgtttgtttttcactgaaagcaacatgtttagcatgaaatgcatgggtcttatatattttgataatatacttttcttttaatttaggttttgattggctgcgatgggtcaaattctgtagtctctagatttctaggattaaacccgactaaagacctcggttcgcgggccatcagagggttcacaaattacccggaacgaccatggattccgacaagagtttataagaatcaagatggacaacgtcgtaagcggacgacttcctataactcacaaactcgtcttttggtttgttgttttgcgaaattgtccccaaggtaattaataacccggtcatgctacatttcatactatacatagacttctattgttttcatataacgcactaacgtatttataatttgttttataaatagactcaaacttcttaaaaaatcaagaggatatcgcaagattggcactagcatcagtccgcgaattctcagaagagtggaaagagatggtgaagaattgtgatatggactctttgtatatcaaccgtttaaggtaccgtgctccttgggatgttctgtctggaaaaattccgacgtggcacccgtgacagttggccggagacagtatgcacctaatgggcccattcttaggacaaggatgttcggctgcgcttgaggacggtgttgttttggctagatgcttgtggaggaagttaaatttaggtcaagacggtataattaatgtatcttccttctcttcaaggatgcaaatagaagaagcaattgatgagtacattagggaaagaagaggtagactcgtggggctttcgacacaaacttatcttaccggtagtttaatagcagcttcttcgccggttaggaagctattgcttgtagttatgttgatgattctgtttcgtgatcaaattggtcatactcgatatgattgtggcagtctataaatttatcttatgtacgaactgtctaaattgcgagagttgtgtgcttcgtgagatgattgtatcatgaggttggttactcattgttcttgcgaatgtttcctgtttgttcgcttctgataatttttgttcgattattaaaagaactatgatattagtctttctcacttgtgagttgtgaaagacaaaagaagtccaatcaaaaacttatttaagaaaattatgggcggtatcatctgcaaaaaaatattctcaaaaacattttaatccaattaataattctggattcaagttttttggaccaaaaataatcaataattattcaaatacatttttcgtatattttgatgaaggaagagaagtccatatcatttgtgttacaaaaaccccaccctagttgataaaagacttaaagtctgcattataacataaacagaaccaagaaaatgtagagagaaatgtcaaattatccagtagcccactcaaaatgtagaagctgaatcaatggaggtgatagaaaacttatctagagaaaaccagaattgcaaaggctcaattcgaagatgttttttttgatgatcccatctttattcttatatatatcaaaagtttaatagtatagaagatcgattttttttttgtcagtttagatttttgatatactaggaaaagccaaaaagataagtattgtgtcacactcattacaacaagtacacaaaattgatattggatggaactagttgttttatccaaaagccgagttaatgtaagtggcgtcataggcttgcgtcaacaggtcaagttacttcataaacaaagagcgcttgtttgactcgcaaagacccaccacactcacgtaaattgattgtctcccaagtaatttaattgtcttaatgaaaagtcttcgctgttcctctactctatataaataaattaaaaacactatactacatgttccctataggactacagattattaaaacaactccccaaacaaaactttagatctgaaaatctcagctttgaa

SEQ ID NO: 5047 - DNA, 2000 bp, Arabidopsis thaliana
atgtataatacataaatatacgtgggtcgtttgtttcttaagaatgttaaagttcaccatggatttggtaaagtatttctaataatccaaggttttttgtaatttataaaagtaattaataatcaaaggtttggttgaaaatatattttgtgttaaggtatggttgcatatgtatatatttagcaaggtatttttgcttttctgtacaatgcatatgacatgattatccttttggatgaaaatgagaaaactactatactacaacaactatagaaagcaaaccaaaataataattagaaaaataagaagaacaaatcccaaatgtttttcatatcatatcgcattgcattatgttacaacatagctctgtaatgagaattttgaatttcatacatgtatttcatgttaaattatagtttttgactacataaggtatgttttagcacaatattatagtctttagctacgaaaaagccgatttctccacaaacttgcataaaacaaattcacgtaggtgcacacatgaatttcacatagtcaagatattacggtacaataacagagttagagcatatgcatgattatgcacaaaacatgaagtgtaagtatgaaattcagatttctcattattcgaatttaagtataaatttaacataatgcatttgtaaggatataaaaaatctgatttgccgtgtttaaggtaagtgtttttgttgactccttgttgggacatctagcttcaccgtgtcactccttgaggataagactaaaaatgtcggaaacttctctcaattttatttgaacatgttcgggtttgaaaaccggtttatgtaactatcaagaaataatcaaaacaaaaaatccaaaaataaacttcaatgtgaattttgatttgggctatatatttcaaatttcagtctaaaatttattggcaacaatattattaaaaaaaaaaacctacattgttattacaatggggaaacttatttattaagcggtataaaaggttttatacataagtaacgaaaaagtagtaagtaaacgaccatgagttggtaattaatttgcaaaaatgatggatgatacgtaaaagtttaattatattatgttaaaaattttacttaccttaaaaacaaaagagatcagatttaaagaaaagagaggttagattaaaggaggaagttctacaagaaggagaactatggatatgttttggtcatggaagaaatagtttgctagatttgtaagtgctctgtttttctttttttcaatcatatttggattagaagttataatcatttagcaatttgcaacgtcctcaaagaatgtttgaagctctaattcttctatgttcggttaaatataaatatataatgacggtttggtatagcatatagtttgaccctactgtttatgactcattcatgatgacttgttcgcttgaggaaacaaattttttttttagatagatgtttcattatcttacacggtttcttgacattttcaacacgaatagaggaagtgaatgttgatcacgtacatttgatgaagaagtcaacttgcaatgttaaacatgttcctcttattttctttatataacatcttcatttatgacgcggtcaggaagtcatcatttttagacttttcatcgatgcattatgcttcgggttctttgttcttggatttgtctaagtcttggtttcttcctttgattttggatataatatgtagtaataataatatattgagggttccgtgtacttggactcaatcaaatggatgacaagaatctccgtaagcgaagctaccccgaaatacaagccaaagacttctttttccatagaaaaatagctggtcataatctaaaggtatagtagtttttgaatgtttggttagtagtatataagccctagacagataggtttgatcttataaaccctcgccaccattaccaaaaaccaataagccaagagcttttctcatttttcttcttgaaaccc

SEQ ID NO: 5048 - DNA, 2000 bp, Arabidopsis thaliana
taaacggtacgtgatattctaatataatcaatgcaagtataatgtaagggaagaaaatgtcacattattacaacttacaagcaaatcaaccaaatcattagtgttgtgccagcttctttacacaactcgccacgaaaccgacttagacgtaatttttaaaatgatataatgaaagcgtcaaaataatattcccaaacctcatcctcgctttcctcaagtaacaaactttccttcgtccgcttttgattttttgaacttttgactttttggatatcattcccaaatgtttttcaaacatctcttgtgaacgttccaaaaaaattgaaaatgatttattaattgtagagtactcataataatatatcaaatcatttttcgggtattagtgttacatattcttttggagttcaattacgatttttttttttttttttaatgttaagaatttttgaacttccgtaataatgatggttcaaacaaatttgaaggtgaggaaatcacgtaaatttcgaaacttcaaagttcgtttgggttcccgcttgtattttttactgtttgtgttaggttataagttgattttcttgttatttttagtctttttctcctatttatatctctacgtaaattttgtcgaaattttgaaaaatgataaagatgataaagatatgtaacataaaaaaaaaagtgttaagaaatttggaatctaagtgtagataaatttcaagtttatatttggaaaaataactgtacttgtaaatatgaggattgcaaaatctgtctactgttcatgcatgcttacttttttaattaactgaaaattatcgctacacatatcttgttcaaatgttttcgctttacttttacgatgaacaacactaaattttattaactgatcttacaaaacttcgataataaaaatgtagttacggcgactagtcatcacacaataattttagcactactttcaattcatccaaaataaaaatcgtaactaaattgtgtcttaaaatttacgattaagaaatcaggaccctagctagagtcaagactatagtatatatgtaccaacttcttttattttttgtcgatcatcattaggcatgacggattaacaaattaaatcagtagttttaagtcttcactattcatggatagataatttgacgactaaagtaatcagttatcgaacctctggagtctggatagatgactacataaggagtaatggagcaattgttgcaatgtccacatattgaggtatacttaattggttatttgtcttaatgaaaaacaaattcagaataatagtttatactagtaaaattaaaatattgcctcaactaataagttgttatgtgcaattatatgtggttgttgtacatgtgaccttaactaatattaagtgaaacatatacatttaaagataacgcctaaaatttaaatccttttttttttcttaagtccttcaaaacattctcaatcatatgaaagtcttgtcaatcaataaaagtccaaaatatatattttagacccaagtggttttagagaaaccccgttttaaatcattactatttcattaaatttacttttacatttctttcagaatcgaagttgccaagaatatgaaatcgaaatagattacgatgaacattaattacaattctactattatcgacttagctggatcaaattttcagcatatcatatacattgtaatataaattattaaatttacaacatggcaaggaatgttacaaagtcgctcgcacgcctttgcaaacgtttctaagcttaattatctaaacaaataatataacctttgactttcgcatgtattcggcatgtatatgaggtgtattaatcttttaggctctaaattatatttcgaaggttggctttatatatatatatataccttatggttgatcttaaatgactcacaaccctttccacaagaagttataaaccaatacatagaagaaaacttccaaccccaaaaa

SEQ ID NO: 5049 - DNA, 2000 bp, Arabidopsis thaliana
aagaatgtgtgtaatcgtcattgtaaacagcaaaattacagaagaatttaactagttgtgtatttgctatatgtagaccattagtattttgtcatcttaactttcatataaactggttttgtcgttggctaaaagtatattaaaaattttaaacagaaaaagagtattatggtaggataaattgcaaaaacaaattaacatatgctagtttttacctggcatttaacaaaatttatgatttctgtttttatatcgaacatacatagtttcatgatacaatcaatttttgcacttaggtatgtgaagtaatagaaatggaagaaaaaaatacaagaaaaaggaacttcagaagattttttgtctccaagtgaaagccggtccttagttttgagaggcttgaagcacaaaaataattatgtggtctatcaaatatttacgacttaaatattgtattacaacattattaacatttaaatatcttaaatagctaaaaatataatatttttgactttcaatgaggcaaggaactctcgagagaggtcttcctagacccatgttggtgaagatagcttcgacgtcttctaaaagcacctccatcgattatattaacgagtgtttatactatttttttttaatataaatttgaaatatttgtgaaaggagaaaagagaagaaacatatgttaaagacactttttacttacatgtcactttttgattgggtttaatatttttacaatttattgattaaaattttaatctaacttaagacacttcactttgatcaccggtgcagatactttaagagcctcgcttcacgaagaaaaaccgaatcggaataacgagtgggagtgaattcggtgagcatgtaagtatcaccctcatcgcataaaacctccttagcttcaatttcgaaaagggaattgttatatactgattgaacaaaataaagatattctatagtaaacacatgttatatagaacaacatttgagattgatattgtaataatggagagaggtagcttctaatgagtatactactaaagtactaataagaaaactaaatttggctgtcacatcttatctatttgtttatgtggcccaacatttccaatatatattacaaaataataataatggataggcattgccaccggttagattataactcttcgtttgagtgcgacatatttgtaaccagagacaataattaggataaggattgaaccaaggaactaaacaaaaatttgaggatgaaacatagtccaaaacaaaatccatttaatttttgggacaagaacatagatatcataacacttaaatatgtgcctcaaattggtccaaaatgctctcgtgaatgaacgtggattttgcaccactcaacttaattacttactttgtcccatttaaaaaaaaaaaattataaaagcaaaaatattaaggaaaatttttcattataaaaatatcatctaatattttaatttaaaaccctaccataaatcatagaaaatactgcagcatataaataatcataaaattaaatagaattttacagtgatttcatataaaatactacagaagataaataatcataaaataaatataattttgcagtaatttcatagaataaaatgctccagaatttaagtaatcataagaaatctaataagcattttgtaaataaaaaaatccaactttgtctccaattgaattctgcaaaaaatccaactatactgcaaaacaaattccaattatgtctccaaaacgaatttgaaaacaaattgtgaagaaaaatatcattatattttttgtaaagtaaataaaattaaaaacacatttatggtccaaaaatttagttttttttgtttttttagttaatgtgtattttggcatgatataaagtgcgtcgtgtctcgactatatcatctctcggtttcactattgaacgtgtaacactggtcgaaagaagacgaacataaactcgtctccggtaaccaaaa

SEQ ID NO: 5050 - DNA, 1962 bp, Arabidopsis thaliana
ccaaccaccaccaaaggtaacaaagaagcacaaaaaccaaactctctactgcagattttgtcagaatctaaacctttgctcacaaagtggtgtttaatcttgttgtgttttaactaaacattagaatctgtgatgcaatggtatgtgcagagtgaaagaaaaaaaagattgttggaatcattgttgcttattgtgttagctaagctagtagttagcctcaaatttcggagaaagcaagaaaatgccttgtaatgcaagattcttacgctgtaagccctagttgaatgtgtatacggacatcttttatattattttcttttgtcagttttgtgcttagaaagcgtcatcaagtctcaattattatgcaatttcatcttattaaacttttgtagcctatgtggttatgtcgagacgtatttggagtaattcaatacattaagaataagctctcaatcgacaatcagtagtttttatctccaattgaattacagagatcgaactcgggttcttaatcttaccagacccttgtgtttttcctcggtttcatatgtgggttaatgtttaaattgttcatggtgtcatcatttatttttgggcccggactggcccatccgaaaagtgggctaatctccaattttcatagcacatattcttaataccaatcattaaccatgtcatatttctgtctgcgaaaacaaaacaaaataaagcacaaaagggtatatagtaacttagtaagcacatggtggatgagacacgtgtctattttctggtggtgaatggcttggaatgagaagaccaaaattccaccaccgttattattggagaaaaaaaaaaagcgagagagagagagcacttggggtcgctcacgtcccaagtaacactgaaccgacgtcgtattcgataatgattgatgaaccgttgatttcctcaaactcacgtagcttacacgcgaacctcccttcaaccaatcatgtgctgccatcatttagcgcgtgtctctcacgtcccgacacttcctcctacatagctcaacacctcctccttggccactttttgtttcttttttcttttgctaattataaagtagggactcccaaatataaacctataggctaattatataaccaagtgtcccaaatattgtctcccaaaatttttttctgtagttagggtttttaattctaagaattttcttttgaattctgtttattatgcaacaaaagaacgtttctatattacaattttttcaagcaatctacttctggttaatgtaaaacataaatacacctttttggatattatataacaagatgtaataagttgaaccatatgcaataaccattccaaaacgagtcgattgtgctatcaattatcaaactacttttagttgtgttaagttgtcatctgtcagaatatttcacatcgtaaatcaaaaaatgattttaacattttcattatgcaaagataatggatctttcaggatttttatcaattaattttgaattaaaacattcttttaaaaaaaaaaaatagtattagtgctatttgtgaaatgatgaattttcggatttttgtcttttgccgcaaagaatttttgaattatataagttaggcaagaaaaaaaaagaatatgtgaataaactattaaagcacgattaactaatcatgattgtgtttattagttcaacgagttctctgttgattgagtcattccacagataaaaaaaaaatgtagactattttagataatttattttatttagttccataaaataactcaagaaataaaaagttttgagatgtcaaaaaaaaaaagtaatgtaaaaatgcattattcggagatgttgatgactttgtgcaaaattacctaaaaccttcaaccaaaatcaccaacttcctcaacaaccgatggacctttcaatatttctctgaattttatcagaaattgaagactctcag

SEQ ID NO: 5051 - DNA, 2000 bp, Arabidopsis thaliana
taattttacacatcacgagattgtacaattgaacgaaacttaggttttagtgagagtttagataaataagaaatgttcatattctccaggtttcagtatatattagtttagttctaatgcaaaaatttatttcaaagtaccaaagtattacttattactatataaagatcaacaacttgaaagtagcaacggaaatttcgattacataatatattttactttaggaaatgtcaaacacccatatgataaaagtatgggatccataccaaattataattgtccactctaatgattaacctttgtaatggtctatttagtaatgatctaacaaacatcaaataatctttttaacttttaccatgattataataatatagataattgtgattataatgcatgtggatactaattttgtgatttgagttcttgaaccgatatctcctatgatttgtattttgtgggaattttcttaccagaattccttcaatcaaaaaagttaatgggcttgagatagtttttatttgtgagtgggcatgtgatacaccccttatattttcagtttcgggttccaatttgtcaccaacctcaatttacaaaaacgctaaacatgtaaacgctaaattatccaaagacacaattgcaatcaatctaataaaagaaaccataataattttaaacgtcattttaccttcctattactatgtacaaccacttctttaaacatgaatatcaagatcaatggtgatgaaaacctaaattaagaagattttttttttctttcccaactctctaagagagatcaataccgacgactttcgctggttcgtgtagattttataaaacaaaaagcattggttagttaggagattttgattcaaggtttttttatgagaaaaatggaaaattatataaaaacaattaatttttcttacttgaaatggacaaaatttaatttttttccataattactttaagtatagttagccgaatatcaaaacatataaatagaaatagcattgttcttatgccattcttatattttcatttttagattatttttttttttatatcttttttgtttttaaaataaaaaattgaaatttattcttcttacgagagattgttttaatttgatgacaaaaaaaatttgctttaacttgttttgtattaaagtaaatacatagaaattaatttatggtaacaaaaatgttacaacaatgaaatataattatatttgaactaattagtattctagacatgaaacatatatatatattaaacataaaattggtttttaaaacaaaataatcaaaacgatttagttttaaatcattgcaatatattcatatatggtttccaataatacaaataaactacatagattataatatttttctttctacacgaaattataatgtttagaatcacacattagattccaaaaacgacttcatttttattttcactgaaatgctaaaataacttcgtcttaaaactatacattgcaatttatccaaaattataggatttttcttttgtctgtaaattacaataatttatctaccgtaaaatttcaatgaaatttacattataacctcttaaatcttctttttttgtacataatatattagcctctcaagtatattgaggaaaataaaatatttaaataagaccattgcagatgccaacatattacttggattgaatattgaaatataagtcatttattgtctttatgacataaaaattcaattaggaaaaaaaatcaattgaaatttgagaagggaagtgataagaaaaagagagtaaggtgatagaatcagtggctcaaatcacaccaaaatctccaactcacttctcattggataagacaactatcaagaagccttcaatttccattggtcctcctctctccttctataatcccaaaaaccatctcacaaactcatcaaacctctttctcatctcatcttcaagccatctccgatcatcatcagaca

SEQ ID NO: 5052 - DNA, 1566 bp, Arabidopsis thaliana
ttctgagtttatcggtcggataatttttgaggtgatgatgatgatgatgataaagttgtgatgtgttgtagcaagaattgatcgatatgctttggaatagatctctatgtgttatatatatgaagcaacatatgcatatgttgcttctgggaagatactcatatgcgttgacgaagaataaatgtttgaccttgtactaaaacattgttcggtacggaagaatgattattaattaccggtataatatacggtttaggttttatatgcgagtagtgaagtgaaggttgctaataaaaatcagaattccggttcaggtaaaccatatccagcaactctaattaaatctcctcttggaaaggtttttgttttaagtcaaaacacaatctcattttgtcaaaatgattttagttggtcaaagtaataataatacgccatgatgatagttattcttggcagcttaaggattgaataattagggctgctctatatacaaaacatatattaatgaaattaattatgattatttgttaggaaaatcaactcttacaagagtcgtctactgtgtcggcttttgcgttaggttatataactccaactttcctcctaataaacgggtccactttttctaatgaaatatatattactacttttggataagaacatttacatgaaatccaataaacacccagaaataattgttcttggcttacaaataaagaaactcacatatctcattatatttttgaataaatggacgtagatgattgacgtacatttcagactaatatggtttgacttaattgattaattaaaaggtgaaaactaatctttaattttggtgtcactctcgatcgataaaaattcattttttttgtattagagtttttgttaacaacctaatacgaacaattgaacttgcatttaaaatacacttcatgcggtttatttataagttgattatggatacgaatttaagcttttgtttaatatatgaaagataactgattgatcaactaattcagatgggataggtttgaaaaaattaatcacaaaagggtaaagaatttgactaattaagctcgaaagtgttcttcacggcaagttcgtctcttgaaacaactacgaaagtaccactaaacctatagtatacacgagccttttccaatttccacgagcactaaatgtttcaaatgtaatttgtgtttggtttaaatcagaccgcttgaagtccacacgatcatagtattcaagttccatgatttgtactaagatttaatataagtataaatgggcctgcatgaagcccaaaatgaaaggttttgaaagaaaatctgcactgtgatgacgatgagacagtcttatccagagttgaaatcagccaatagacacttgacacctcagcaagaggtaacctaaacagaatccatttctgtgatcgccaaagccacacgatgattcttgcctaaatcattttaaagactgtatagaggaaaacaaaactgcaaaaacaaaaataaaaaaaacatcgcacaagaaaataaaagatttgtagaatcaactaagaaa

SEQ ID NO: 5053 - DNA, 2000 bp, Arabidopsis thaliana
gctatgttgtacgaaaacgcattccaaaactgtatttcacccatgtattatataatgaaaatctttcagttaaaaaaaaaaaaaaaaaaaaaaaaaactagcttatttgggttgtcgtctatatcacatatctaatcgatgtaacaattcactgaatcgggtgttacaaataacatttgttttcttcactaaaagtataagatactggtacaacgcgaaatctaacctatattcgaatcaaatgacacgtcatcacttgggtgtctatttgtccacagttgaaagttataagaagcagacaagtgtctcataaagacatcgagatctgattcggttctcaggtacatacagttaatcgggagtgttgctttcccctagaactatggaggctactatttaagtgtcgttgtgtaacaaaaatcctgtgtttacttgcattacttaaactcctttactttaatagttttatatatgttttcgacctccctttttcgacggagtggatcgctatgacatgtaggcatctgattgtatttgctaatctgtttttgttagtatgttaaatttttaacccaatatatgtttatagtgcttatatattcttactttagttacatatgaatatatgatcattgatgaattaaacaatataatgtaataattaaatttgatttccctgatcgaattataatttatatgttttgtaatacgaatcaattaaaatattttcttgttacacattttgataaaatgtcgtagaacgttacttaaaagtaatgatgcattaacaaaatgtacaacatatattataaaagttatcatcaatattataggcattcgactttcagaatgtgtatcaataatcgaagtagtaatggaacgattattgaaagtatactacggtctctctttacttcatcgtggattctcattaaaaacaaaagtactttctctaccggcaactattgaaagtatattattgtttttaataactttgatagtgtttcttaattattattcccaacgtacgataaaattttgtttgataaaactcacaaaagtttagtatatttctgtaaatatatgcatagaagtcatagtgattgacagaggaaagacgtctctttgactactcttcaatcgaaaacaaaatgtgctaaaatttcaaaagcaaagtccctaaactcgcctaactccatttctcatttgactttgccttaaatgtcaatagtcctatgttatttagctacattcaaaattgggaattaagaattattttagactccatatacttagaaacgaatccgtattggaaactaatttccatttagtaatagtatttaagtattattatgcttaccgagtagcatgtagtagtttcttaatgttagctaatttcaaagcaaacgacgaatattaaatcgtgattgcacacaacaagaagtgattaataaatcattaatttcgcccatagtaatcactaaccagagtaattttgaacaagactaaggatgtacaataacttacgtctgcgatactgtgtggtaataaatatagaaactttatgaaatagaactctcttaccaaagaaagaaaaagcaagagtgcgtgttactatacatctgaacaagtcaaagggtcaaaccttagtattttaaaattacacaaacaattgaccaaatggagagctaattatgtttagcataatttactatatagttgcaaaattccactttagaaacagaataaaaaaataaaaattgaacataacacttatgccgtgttccagtcactcttcaacattctactcattttcaaatatcctttttataaaatactacttttaaaattatttgattcttatgttccttcactatatatatataaatatcgcacattgcttaatcacttcaaatctaatccacaaaaccattcacaccatctcatcttctttctctctatctcttttcctttcctcatttaaagtttctttataagaa

SEQ ID NO: 5054 - DNA, 2000 bp, Arabidopsis thaliana
ctttaagctagattcaacgtagttaaaaaaaaaaaattcactgtaatatatgaatacaaaatgactaaggagtgcaatccgtatcaaaagttctcaaacaaaccaaagaagaaataaacttattggattagattttcatgtacgagccctaaccgaaaccagactaaaaccaaacactaactaaaccataacaatagtaaccgtaaatccaacctagtgatatttaatttggtcttcattccatttcaaaatttcaaattgaatgttgatattttttgttgtttattcatcacttattagaattcattttgcattgtcatttacatgcattagatccaagatgtttaattttagttacctgttagtgcgactttatagataaacaatccactaactcttaagaattcaacaactaattttgagatagaaatatataaagataaaagatgttagctagttttttgtctttgtaaatataagactaattagggtttgacaaaaaaaaaaagcataggacgtgcaatatttggtaagagcagttgttcccgtgattttgtcagatatgaccagcatgaacagttgtatgttgtaagaaatcagttccctttttctcaatgagaaaaacaaatttaaacttgacttaactctcatactagtctttttaatcctaattattaacaatctttaataatatatgtaatgtggcaaaatcctaatatatactgacttgaatatgatacgaaagtactaattttaaagttttttccctttctaaccggtcgatgtaaccgtatttgcatgttttcttagattattttaaataatatatgtctatcacctatattagtaagtatatattcatagattatagttgattttgcccaaagaaaaaagaagattatagttgattataccacatcattgatattctgtgacgaattagattacagttgcggtaaacgtattcgctagctagtacgacgtgcttaacgcaaaaatattcaaagataacgaatccgattaatattggttcgtttcttaattcttacatctagaatcacacataaaaacaataaaataattaaaaatttgatgaattttttatttttttgagtgataaaaggcaaaatgttttccgttttttagtagctttctctttcaaaatatctatttctggtgtatatcgtgaaaaaaactttcaaaatacgtgaatgtgatgatcgttgaaaacttcaaatctcatttcccctaggttactataaaagcccactatcctttaatgggccaggcatgctatttctgtacaatacaagatggacctgaatgttttaacttttaacttttatctttaaggtcaagttaattgaaaacaaaaaccaaatttgtggatcaatttggatgcctcagcctacgtataaaaacatgtttttttttcgtaatattaatggaaatgaatatgttaaaaaaaaaaaatacatgtttttttcgtcgacacttttaaaaataaaataaaatttaaataaatgtctttgaccaaaataaaaataatgtaaaatttgggagtggggaatgtagctcggaaaaaaatagggtatgtagatcggaattaataaatagattttatattattacataaacaataataaaatacacaatgttgtctttatttaattaatacaaaaataataaaatagacaatgttgtctttattaatattacttctcagccccaaaattaatctttgatcggtcccttttgttttatcgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaa

SEQ ID NO: 5055 - DNA, 2000 bp, Arabidopsis thaliana
gaagtaccatgtgaaactggtcctgccctatctccatcaagttcatagagctcacttgcattatatggtaatagagtgtcacagtttagtgccaacttggaagtgagtttcattttggtgttgatatgaattttttttaccatctacacaagctaaacaaatgaaatgcgtgtccacctagtctgaagcctgaagatgggtaaacataaaaaaaccaatgtaacatctaagtgaacaagtcacaaatacattagcatcaacgggaggtgagaagttaccgttgtatcaccagctataatagctaaagaatgagcatatatcttctatttgactgtcgctctcaagaaaccttgctcgctatcaaaatttccatagacacacacattagacacgaagcaaacactctaagaaagatcaaatatataggagaaacaaaagatagagaaacacctctataggagtcatattggcagtggatttgaagaatctattcaggaacgacccctcagctgaaataagaaatcaaaagtgataatcgataaggattaatatctttagattaatgaaaggaacaaatagaaagcctgaatataactcacagagtttgatctcaaaggttatattctcaatagcatgaagaaggccaatggttccacaagcattatccacattttgtttcatgaagtaaactttatcactatgcacctaccaaattcatcaacacagagtatgaacgatacttaactacaaagacaagggttcttttttcatagaacaacccagatgtttatcagagagaagctcatcctttccttgatttcttggttatatacattatatatataaaaaatatgattaattttgcttagaaataatcttcctttaagaaaaaatgaaatatttacatgaaaatcaaccaaaatgaaagaatttttatacattatataaaaaataatatttttgtttcaatgtaggtggacaacttttatcctatgtagtttaaattaactgtgtatgggggtcaaaactataaaatactaggtcattataattattcctaagaaaaaaatatagttgtttttattttattttatagaggtcaattgacccccataatactgcactgcgtatatatgtttttgcattccgaattttgttttacctccgtatcatagagactgaaatatatatcgggtcttgtttacacaaaaaatcttaaaaataaatgaggttaattattatacaatatttaaaatgaagagacgtatccagtagcatatctagaaattgttgttgtaggggtcaaaagttttctttaatatataaaataatatacattatagatattaaaaatattcttaattttgcttagaaataatcttcccataaaaaaatgaaatatttacatgaaagtcaaccaaaatgaaataatttttatacattatataagattaatatttttgtttcaatgtatgtggataatttttatcctatgtagtttaaattaactatgtatggagtcaaaacaatataaaatacttagtcatcatgattattcttaagaaaatatagttgatttttttaattttatagagatcaattgatccccataatactatactgtatatcttttttcgtaggatttagaatggaaaaccttttggaataattcaccaatttacaattcattttatgattttgccatcacaaacgacatcagagtaaatatgactaacgggcccggcccaataattcaagattagttttttttaaggatttctagggtttttactttttagtatattatcttcttctctctctaaccctcagttctgttaagtacttggcttctaacaaacgctgtctgaatcatatttcgattctgatttttcttcatggattcgtatagccaataagttttttcaatattcaaaacaaaaaccccatcaaaataatctccggaccagtttctctttcgattcagtcggaccggaaaaaca

SEQ ID NO: 5056 - DNA, 937 bp, Arabidopsis thaliana
tcatggtttgtgatttgaccatcaaataccaactgtgtctgaattattcatttgtttgttgttaaatttgaatggaaagaaaaagaaagaaaaatctagttatgatgcagtgttgtacaatatggaggtgagtttgaactaattttttctttttcttttttatcataaaggtttgttgtaatttttttatattttgtgatgaaaacctgtaactctatcaaacttcataataattaattttgttgtaaacttagataggagttcatgcatttcataagcgttttcttcaaatttttactgtggttaattcaaaaacaaataatcactcaagttatattctttcaaaaaaataaaaattagtagaatatttaaataaaaattttgtttacgtgtcttttattatattacagtatattttaaagtataattataaaattaagcggcatcaataaacacaaattttaattttttttttaatatttacttgtcgaatgcacattaaattaaaattaaaatgattcatattcatatgtctatatatataacttataacaaattatatatatatgttaacatagataattattaataaattttctctcataatttatttagaaaaagaaaaaagaatagaaattgagtaaagcgatgagaaacgtgtgttcagagatatttgataaaaagaagtaaatccatctctggccgtaattggctgtggcagccacaccctccttatccaaaatctcctccttccttaaaaacaatcttctcttcttttgcttctcctttctttgagtcgcttcacttctcttgcatccttcaaactcatccacaggtaataatattaatcaaccaatcaataatctctcttccaacttctcttccgatcataaccatttcttgaatctgtgaatcttgttttctttttcagcaagga

SEQ ID NO: 5057 - DNA, 2000 bp, Arabidopsis thaliana
gaatcattgtttacattttccagtgaaaacaaaacatataatgctaaaccccaaagcttatatctgaacagtgagagctgaaagcaaattagattcatcttataaggcttttatatagtaatgctgcaagcaggccttaagaataacgaaaccctaatagtgaaaagaaaaaaggtgggattattgttaagtggaaaagcgattcacttttcagaaacccgatttagataagaaaaatggatctgataaagtttcctctgtaacccaaaacaagtgcagagtgacaaaagagagaaaagaacaaaccaaaatcatcagaagaaagatcctacgaaactcgaacgagccaatccaaatatgagattacagagtacaaagacaaagagagaaacaaagcaaaagtgcaaggaatcagagaaaatcagaggaaaagaaggaacctttaggggatcaagaacaattgatccagagacaatgactgactatggaaagagaaaggagagagttagtgattgagtagttgtagtagtggtagagagagagagggagatgggtgagatctcattaattgaagaaagcgaagaatcagagaggatgagaagaagaagaagaaaacaaaagagagagagcttccctacagaatcttttttggtcttcgctttctttcatgaaagatcaaaatcaaagcttacttgcttttgctatttaatcattttaaaaactttcctaaatttccttctttttttttttattttcttgttacaaagaatatagggaaatgaaaatcaaaagatcaatttttgtggatataattaaagattgtttgttcttaattgcattgtggttaattgtatgatggaaaaaaacactattcagcttctttttacttagtcaacttcttaattgctttttatttagtcaacttatttttttgtggtgtcctaataaaagcaagacgacataagagacgagaaataaatgggacacttgcaaagtttgcaaaaacagatgagttgtccaacttttctccacatactactactaatccccacttcgttatttatttattttatgttccattaaagtctatccatatgaatttcatgcatattcacccaccaaaacatttcactaaagaaaatgagagcgaattatatggttgatagtcaaatagagatgtgaaggcgatgattaaatttattatcagttatatggagtaattcatgtttttagagaatcatgatatccaaaacatttcttattaatatgcagttttgtttttgcatttgtagttttcacaataaaaaaaaaaaaagacgaaaggataggttggttggtagatcacgaatataataaatgtgtaaaattagattggagtttaataaagcttcttttcccatttggttctgttgacaaatcgttcacggagttcccgcgtaggccttagctttcgtttgttttttctttccttttttcacactgggccaatcaaagacgatttaattagaaagcttattatcaagatcaaagattgtatggtttttgaggatgacacatgaagaaattaaaaaaaaaaatcttaattttgtgaaatccaaagggatcatcataatcatcatcccatgtgtctgacagcaagagaagaatgtcacgtgtttgtgggtcaatttaaccaaatgctatatcttccaattgcagcattatcaaaaattactaaactaaaaaggccacgcacaatgactcatcatcgcgtgggctttgacatatgggccttatcttaatcgggctttacaattaaaccaaacagatataaaaacaagcaaatcctgacctggcagtggatcttcatgtgtcatcctcaaaaaccatagaatctaagataagaagataagggacacgtgtcaaaaatccaacacacagaaacacattttccccgatttactaacgcacaacaaaactctttcattctcttcttacaccttttctccagagttccgaca

SEQ ID NO: 5058 - DNA, 2000 bp, Arabidopsis thaliana
ttagatatagttaaaccttaattaagttttgttaagatttgcaaattggccacttacttaactctggttaccccgacattaccttcgaaattttaaattaaagcgtcaataacggttggtgggtttcatctcgtgaccactgactactttttagttttacttactgaacaaaaaagctctttatcagaattttgaatataccacttgtttcctatttcggataaattgatcatataaaattataaagtaaaggtttttctcttagaagataaattttttttctccaaatttgcataccatttaaaaaatgaaaaagactcttttaaaacaaaacacaggctgggactgataatatgatattctagaatctttcctgaaaaagaaaacttacatagaaacttcttcttactatgaactttttgtaaaagaaaaaaaaaggttcgaaatgagtgaaaatgattttaacgtgcattaaacttgtttgatatgaatcaattcatgtaataggattgaatgctgatagtaacatcatacttattttctgacaataatttaataaatgagtacacttgttctaaagttctctttgagaattctagaatacaagtctgcttaatcaaaaggctattttaagataaatgaatttttaaaaaggttaagaaaacgtatgaaagacttactgtgatggacatatcaatcgacagttattgggagtttttttttggagtagcaaagaaatgtaagaaaaaataatgagaagaagataaaagccaaagttgtgaggcttgtcggaccaaaaatggccaaaatgctagcaatccttgaaaacaagtgatggtaactggaacaccaaaatttaatgggttgattgaatcattgaaagatttgactttcaatatttttgatattttcctaaggagacttttatgacttttctttcattagtctctctagccaaatttgttttgcacggctcacattttgccttcaacaattttcattacttgatctaacatagttacttcttaaaaaggcaaaacaaaatttactttaatagctgagtttcttttttgtttctttaccatttaaatcatatagaatggctaaccatatttgaaatagtattgaatcgaatgtatctaccattagaccaccatgaatgatttcatttatactcatgtattttacagtttgttaagttgattcatatactaatttaacaactgataattgttacacatccattaagctttcatcaatacttaaattaatagcaaaaatgaataattaacagctaaatacacccaaattttacagaaatattctactcctacaatttctaccagtcactactctctaattttggtataaaaatcatatagctcactatataacagctatcaacctgtaatatataaattctgataattaatattggagaatttagtctaattagctaaacattttattcgtataaagaaactttttttttcctcgtataaattctaattttcgtttcgtggtttgaattatactttttttgtttttatatataataattttcaattcaaccgtttctccgtgttgaactctaggcctttttaatctatgccttcatttctcagattcttctaaagaaaaatttcgcttttctctctacttcaaaacttttgataatcttctttaaactttcttcttcgatctctctttgttaactttctttcgttacgtctctctcgttctcgttatttcttattctcagatcttggattcacgaccatctcgatcgttgaccgtcgaatttgggttcggctaaaaatccaatctttttttttccggtgagaagctcgagagagtatataatttaataaagggtacgtacgattttggttgagtgttttgatgatgttgacccaatttgttggggtgtgaagtatacttatggaactgattgtcacaatacaagaagaacaacatcatcaacaaacaagaataataag

SEQ ID NO: 5059 - DNA, 2000 bp, Arabidopsis thaliana
acggtatatatgaacgttttgtaagcataaatctgaatttttttaaaaaattaaaacgttaccattgaaagtaagtattttgttcataataagtctagataaatccgaatttcgatagatatatagtttgtaaattaatacttgacaaaaaaaagaacttttcaattagtgaaagaaataacaagctcgcatgggggttattgggctaagatcactaaaagaaaagtaggtagtagtagccaccgaccgaagtatttctttctgattttttgttatcaattatcaattaatttcacaagatacgagagagataaagattgatttattttcttgttacttgatacaagattttttgtggcacgaattattataacctcaactttaacccttttccgaaaaaagaaaggtattataacctcaactattacaacttggaagtaattaatcgtatattgtgttgtttttcgtacataaagagaaagtactatcattttaaacttattttattttagtttcacttcttaatgagtttgggaatattttctaactttagttaaattatatataatgtatacttttcttaccaaacatttgatttaaaggtttttattgatttgttaaactatgaggaatattttttccctattatggaagaatccaaagataacttattgtaattatattagctggccaaggccaaccggtattatcgaagaagcaacctcataatgatcaagataatttgacagaaaaatgatcaggttaatcttcttccttcccaaaattaacaaagttgatttataatccaaaaaggaccaaaatcatatacgtatctttaggttgtggttggtaatccatgaattagaacgataaactgattttgcgattctgtcaattagttattgataatttaatttatgttttgttatttcacaatttatttgacaaaagtaaaagaaaatgatcatcatatatacatcataaattttcagtccagttaagaaaaggaaagaaaaaacttcatttcattctaattttgaatattactctaagtcaaaactataagtcaaattcaaattctctcactgaaaataacatatttttacttgatatatatacatcagacctacttgccaacacccataagaacgaggaaataatcatgcaactcgaagatgcaagatgttggtgatgaaaatcatcctcttgtatatgttaccatctacaatatatataaataaattactcaacatggaatttgtctcctcatcctgctattatgcaaaataagaaaatctatctgtcaaatagtagaattacaagcacaaacgattttctatttattgcttgtacgcattttacaatgacttagtcattccctattcatagtgattcaaataaaatgatcaatcatacataactagataaccaaaaatccaaaatcagtatattgtaatattgttatttgtcgagattgatcgtatattacacatcatccctagcctttttttttgcatctaatgactccacaaagcaccagcagataaaaaaactcttcgagtctttacttgtacgaaccttataaacaattattcatgtttttttttaaaaaggcaaaagaaataaccaatagaattgtagaactagagatacaaatggaaaacaccaaattttatcccatctcaaaagcaggagagtaaggtccccccaattatattgcacacacacaaatacaacttccccaaactctttttctttctaataagaaaaataatttttatatttagcaactattatctaaatgacccaattatgtgatcttatgactctatgatacttatctatcgttttacttaaaaaattatttaaaagacttaacatttgttttattatttgcgcctataaatagctagcgaccctctctcaaccccttaactcacacatttagcatcatcaaggatcgaaaacattaagtagctagttaagagagagagagagag

SEQ ID NO: 5060 - DNA, 2000 bp, Arabidopsis thaliana
tcatattttataaaaaatagaccatttgaatttgtgtataataaattagcaaatgagatcaaattgaaccgaccggatgaaatccgttcacatggaccatataacttgtccctccagttattttattttatttcgtcgatgtgtatttaattttgttaatctctatgcaattaagttttcataactaacttatttggtttggttgaggagtttcaaacaagtaaaagcataaacttaaaaggagaaaataggtggaatcatatatttagaaggatcgtcttactaattagaatcatatactagtagttagtggatgtggtataacctatatggctatatcaattaaattgtttttcgtagttatccaaaataattacagaaataagacgaattctcgtagttatccaataatttatttaatgttttcatataaaatctgaagcctagaaatgcaaattatgaaattatgtatggtttacatgtataattgtttatagtggtctcatatgttaaaaaaataattttttttaatcgtgaatgtagtgtggattacacgaaatcggtcgatgtttttcaaatgccgcaggaaattatatttctatgataagaaaatgtttatgatcactaatattagtagacacagcaatatgtaataaataatattaaaatagagagaataataaaataaaaaagcagacagcactaaaaaaaggttattcttatcttttgtaatcactatcactaattttagtaacatactgtataattttaattaaaagaaaaaaaagttcggaaagtggaatatttttacttttgattttttgtcaacagaagagaatttttccttgacgacaaaagaaaacatttttaatttattctcttttattttaacttaacgaaccaaaaaaaaaaaaaaggtgaaatgcttatttcagacagagaaatgaggatttgttcgagatgtgtcaatgttacgcatagcacagggcagagataataaaaaaaggctctctctttctttctctctctctctctctctcttctctaatctaatctaatcaaaaatctcttctttaggaagagaagtttcctccttcgactttcttctttctcaatatgaatcccggaaaatcgggaacctctagcgatttcagctaatctttacttaccttttctttagttctgacaagaagtagcaatacccttttggagattcgatcgtattcgctgttttttttttttgtgttttagctgtcttcgtgtctctgctactttgtgtttgatcatggagagatctgattctagagatttctacaacttcgctaagacttcttctggtcagttctctttcttgttcagctctttttgttttcaaatctaataaaagtgtttttattttgtgattcatcagtttgctaaagcttctttctttgatctgagatgtgaatgatttgatttgcttctgatttgtgaaaactttaagagaaacatactttttgtttcatgcttgttatgtttgatttatcttccttgttacagtatttgattcgttttttttttaagttttgtagtaacctataagatttactaatttgatttttgaagttgtatgaaatgattgaaatgtcacagatttgtttacaaaagctttagttttacttaaattttctggtcaactgattgtcacttacctcatgtgtttgatgaaactggatcttattgtctttgtgcagataacaatagtgcactctttgacgcatctcaatatgagttctttggtcaaagtcttgaagaagtcgaattgggtggtcttgatgatgatggtactgttcgtggacatgttgatgatgaagagtatcacttgtttgataaaagagaggtaatttggactgagtctgttcttggcaatatttgatgctaattatatatgagataaatggaagataaaacaaaacatttacttctggtttcagggtgctggtttaggatcattatctgac

SEQ ID NO: 5061 - DNA, 2000 bp, Arabidopsis thaliana
tatatatcattaggaaaaacaaataattttactgataaaaaatcaactaaatatgttcaaagaaaaataaattatttcgaaatatttttaacgagaacaaccttgaacaaatagtcatgttacaatagtaatttttgttttaattgttagaatataatttgataaaatgattaaaaataattttttagccaattaatatatttcatttgtgtaaaaaatagatagtaaaattataataatatattgtttcatatattagagattttttcatgtttgcttaatatgatgattatgcaaataatattttgagaaactatctctatttttatgggtttctcttttctttcttaatttttctctgcactaaaaaaaaattaccgatcttccacttcggttttcggcattcctcgccggtaactgaagacggatcttctcatttttctatctaattctaatcgagtcatactgtcatgcatgtggtgattttggaatccattagaatccttcccttaagtgtgttatggtggtggcaatgttacgagtccgcatcctcagtcaactagatctccatctccgaggcgcagattatttgagaacggcaatctagtactcttttgttttccacctacacatccttgagttagtgtgatcatctcatttcgcccaaaaagcctcatgaagctttttatgtcacaactaggtcgatcatattcattaacacaaaacctagctacaaaactatatgtaacctctatcaatctatcatgtacgattcttctataaacacttttctcccatttaaaaattaaacaattggagattttttttttgttttgttaaagtagacgtggagatatcattagatgaactaaataattctagtagtcggaagaatcaatttagaatttaacatattttaaatttatattaatttgataaagatccaaattcgaatatctaatttttaataacattttattcgaaaccaaaagtcagtggagacatcatctcgatatgcataatcttagagtttgttggaaagttaatttttgtgggatagctcatggagtttacgacaaaaataataagtgatctgttccacaatttaatcaaattaatagagtcacatgttttggtctaaactcgttaatttttgtttttggtcaaccgttaaacattatgtttaatactatcataagagagttcttatattggttgattatgaagtcgctaatctcgtggtttataataccattataaccagagcaggtaatcgttgaaaaataaatcaagtaggtcatctgctcaaggactttaatatcattataatcattataaaaacttctcttctagtttttgttttttcttaattttacgctttttttctaaaattgtatctataattttgttttgtcttattattatctttttaataattgactaaaaacttataaatttacgaatgttataagttcttttaatgaatgataacaacatgtttattttggtttggtcaacgaatttttcatgttttaaatggtagtcaacgtttagttcatgttttaaatggccacatatgaacttgatgtttaaaatggccacaatttaaaacttgactaataaagttgttaacggatgataacggacgttagaagttccgttaatgactgataacgacatgtctgctttggcctggtcaacgaataatcacgtttttaaaattagtcaacgttaaattcatgatttaaacggccgcatacgaagttgatgtataaaatggccattttttgaaagttgggggattaattgacatttttcccctatgtctatgctgtattttatgatatttttctacatttattatcaatatttgtataaaaaaatagcacgccgtggaaaggcctctctacccaaccttccataaatcgaggtatctaaattggaaatattgtaaagaagacaaaaacttctttttgagttttaccaacaaaaaaaaaaat

SEQ ID NO: 5062 - DNA, 2000 bp, Arabidopsis thaliana
cgctcttcaggcagcactaacggtgtttggtaatatcactctctgcattgctgcctttcggatcaacaagttgtcatccaaaattgaagtctctgaaaagccatgatggctaaaccgatcaatatgagcaaagtataattgaattattaattggaggatcactaagattcttttcccctttgaaaagttctatgagattctatgtcaacgatttaagtatattatatagtctttatatgaggaagatccatgtgcattcaacctatatcagtaacccaagttacacagatttagtcttatccagaatctagagtttgaattaaattataaattttggttacgtgatcataagaacttctccatttttgtataaatgagatcaagaaaacagaagaaagaaagtgccaaaactgataacgtttttcccagtgtggcaagtttggctaaaattataaataaaagtagacatcaaaatgcagatattgagattatcttaactcaaaatgcagatattgaacgtttaacattatctgaactaattatcttgttttgttatatcatcttaaatcgagaccatatatagtaaaacatgccaacaaactcaatctagttagttgaagaaaatcattgtgtataacttacatctgtcacacacaaaattgaatctttacgtgggacagtacgacaattttttttttttttaaatccgaatctcttgaagttaaaaactataagcaaaaatgtggggtggttgagctatttctggttaggatcttaataagaagaaaaaaaatgaacgtaagtacataagtttaaaataataaaattttcgaattattaaaataagataccaagttccacttaaatcttgacaacgcgttaatcgtgtttagaccaagccagggcgtgatgaagaaggcatatcttatctttatcttccccaaaagtccaccaataataccatcttaatcattacttaaacaaccccaaaggccatttatacatttaaatttgttaattttacctattagtttgtactcctattatgggaaaaaaaaacctacatcatttttttttggatcaaactggataaaaaatgtcaattaataaaaaaatggaaagtcagaattcaaaaataaaggaaatatacacgtcagctacgaaagtacagttctgacttcataactttggaaattttacaaaacagtgccattattattccgtttagctgctcgatgataaattataaccgtcagattaggtcagccaaaagaatcgcacggttaagattacgaaagtgtacaataaggaggtgtagaagaacacaacttaaaaaaagtgaaaaccgtagcgtgactcataccatataaatatatacacatgtatgttcctccatagttacgtgtttctgtttttctctaatttttctcttgttgttctcgattaacgaaaaagacttgtcgttctcaattcttatcgatttaagaacaaatcatctaacgaagattacttccgaagatcagaaacaaacacaaactgtgaatcgttgtttgttaattctctttaaaatcgccagaagaaagagatctccgttttctacaggtaaaaattcccaatctcctttgtcttgtgtatttttgattgattgattgatttagttgattctgtgtcttgtccgatctgaattagattcttgtgttatcttagtatttgtgtttcggaaactcagatctacttttttaattgcataatttgatgacgaaattgttgttatcgtagctaaaacaaaatcgatctgtgtcaataatatagttgtacttttgttatggatctaatcctcaaaaacccgacaaccttaaaagatcctctgacattgaggaatctttggtctgactaatctcatctattgtcttcttgtcgtgtatattgtcaataatcgcagtggtaaaattttaatttgaatttatgtggtgtaacagaagaaaagcaagagagtaaga

SEQ ID NO: 5063 - DNA, 2000 bp, Arabidopsis thaliana
tgccccaaccaaccattcattattaattaataaacctgacgaggaaaatgaatatattttggtttcaaatgttttgtggaatgaaggcagagagaaagacagcttctgtaaaagcatttgctggcagacacaaccctaaacccaccttcacttgcctcacctcaccactctctcttcctcgcgcgtgtctatcacttccataaactctcattgcccataattgcttgttttctttctatatgccaagcctgataaatctcgtagtaaattacgggaaaaaattggattccacctcacacaataaagcattttacaaaaccagctttatcattgggttttttaacagattatagtattgtgggtgctcttaatatctggtacacaatagtataaggtctatcgacaatacagagtagactccgggagacaagagaagccaactaggggcacattttttgggcgtaactagacattatatattaatttaaaacttttgagtttcttcgttgaaaaacaattatagaatatagttttgtcttcaatataaaatgagaaagaagagaagaagatctgttcccgctcttttgacttaacggtgctgtcgttttcagcaggttaacctcgaccccaccctccatttttcacttccttctttttaaattattttctctatcactaaaaatatcaaaaaggcgggaaaatcacctattatccaattcagtttataaaccggtttcggttccgtcgttaacggctgattcttctgaccaatgaaaactcgtgaagtctgacggagaagaagacggaactgttaaaatccgttacgtcagacggagaggagggagagggacggatgactgaataaatctgccgaatcctgctgaattgccacgtcagctttattcaaaattctctgagtggtcacgagatttctatggactcttttttttttgttaattaaaagtttaaaaccctacaaaataggggtcttcaatggggttaccagaaaaaaccgaacagtcgccgattccttggtttaatctttgaaccgacagtgtgaccttttaattttctaacctttgctatattattatgaaaatcagatgtaattatttagtgccattcattaacgtgattcttacttataattcctctcatgaatactaaatggagtgtatataattatatttagcagtaaaaatgtattgtattgattgttggaaagggaggaaaaaatgatgagaaggatttgcatgaggaaaagagagagaaggcgtaattatcaagtgttcgatacttttgattagcccacacatttataatattttagtgtagtagtgagatttttatttagggttttaattagaacatagtataagacattggagctgtaaatgacaacttgtttgggatttagtgggttccacctgtatttctcatgcccttacacatttccacattaatatctatcttatcttataaaaaaaagttccaaagaaaagagtgagatatacatatattagcaatatgagtttaatgtgccattcaaaataaataaataacattttgaagaatattaagagtctcaattaaaaaatatttaacttgttctttagtgagttacatccatatcttaagagacatgtgaagagttgaatccaaatgataacacaccaaaattgatggtttttaaaaaatgtgaatactattactgtttttttctttggatttccaaggcaaaatagttaagaaaagaccaaaggaaaatagttttgattttcgtccatcacgcattaattacggataattattatattaagaaggaaaaaaaaaaacaaaaaaaagcagaagtgatattaaagtgcttttgagctgtctcgtagaaaccatgaaaccttaataaaagcaaccttgtcttcaacattctccatcttcctcctcacttaatccccaagttcacacttcaaatccactctttctatttctctccttcttcttct

SEQ ID NO: 5064 - DNA, 1835 bp, Arabidopsis thaliana
aaattagaaagcaaaaacatttttgaataaggctttgacttaaaagctcaggtttttttagctctacttttgtaagaatgaagcaaacgaataatacaatgtatattgacctctaaaaccatatatatatatatgcctaattcatatttctgcaaaaaaagatcaatttttagaagctaaatccatgaacgagttaaaaagtgacctcattcgaaacgagcaaacaacataacagaaaataaaaaggttaaacttaagaaaatgtcattcgcaggaataattaagcagcaagcgtggattcgcgatcgcagccattgaaattaaaatccctaaatcaaagcctatctatgggtctgcgaaacaatgaagatggaattgaaaaataaaccgatagaagaaactggagaagaagaagaagaagtaaattgaaaaaaaaatggaaagaagagggaaataagttggagacgttaccggtggtctctttccaggttggtgaagaagcttccgatatgtttctcatgtttttcgctagtcactgaatttatagatgactaatggactcattatattatctcacgaagcccattgtgttttttagagtcaaggagcccaattgtttttctttttcttttgataagggaggagtccatttgttttagtctaaggtgaggaaatttgggtattcgggtcgggtttggatcgagtctttcgggttcggtttagaagtttaagactggttcgattatacgtattatttaagctataggttctcttcgggtataggttgaagaacccaataaataaccaaaattattttgggtttcaatattatttaccaaaaccttgtccagatatacccaaacatatataaaactatccataaaattataacaagttttcctttattacaataataaaaaacaagaaataaaccttgtttttaacttgttccataatccaatcattaaacaattcacaaactcaagttatcagtatatatgtcctcatatgtatatatatgttcgggtaataaaaaatactcacggatatcaatttcggttcatgtaatacctgatacctgaaattatttgagaacagaacccgggtattttacaagaagatatgataagacctcgtttgcaaatctcagtccatgaactcgatttctttttttcttaaggaacaagtttaactatccaatactgaatatacatcaattcggtactaaatgtatagtagatacgaatttcctccggaatgactcagagaacagtgagagattagtagataagatacttaacttttggggagagacctcaggacccatatgacttgaagactcacaccagctctgaagttagacgggttttgggtctccgggtcaagtttaaagaaaaaatgttaaagtagatttccctttctactttggtttgagatgagtttagaatttagttcgatgttacgaacgtgaatatatacccaaaacttgtgatgtatataaatgcttatcaatctcgaatctctctgttactgtagcgtgtaatccacgtttgaagtttttgttcgattcgataaatgttggagccaaaacagagacatcaacaaaaacatgggatcccaatgaataaatagataaactcttgtctgtctataaatagacttacatcttcaaaaaagatttgtataagtctcctccacttaagaagatatcatttgtagcttcttacaatgtcgcgaccaatccccattgaaggttaaataataaacataattttgtgtcttatctctttagtctttatacaagttcttataataattttctcttcctcacagaa

SEQ ID NO: 5065 - DNA, 363 bp, Arabidopsis thaliana
caccgagtatctgaattcgttctacagaatcgtggatcaaacgctgttataatcacgaaggcgatgaagaatgagagatttcacatcacgcgtccatggcgattcataagaatttgaaatcggagaagatgagaaatgaattttggcggcaaaatcaatcaacccttattacagattctttgctctaattatatatttcattttctaaggttgccacgtcatcacattatccagacgatactgatatgtgatcacacgtgtcatatcacaagtggtttaaaacgattccttttaaccccaaacaatctaaagctttgtccaccttttcggatcactcacacaacttccaacgatcacacacaa

SEQ ID NO: 5066 - DNA, 2000 bp, Arabidopsis thaliana
caatttattttggaaatgtacactagataatcctgcatttataatatattgataattgaccttgacctttaaactacatttttgttgattactatttgaacaacataatttcacaaaagtgcatacaaatattttcatcaatccacacgaaaaatgacatacccctttatttcctattttgccaccatagtaaactacttaataaaggggtatatgctttatttaacctaatttaacctttattttgttgtgtataagtcctaatgtttgtataaacataagtataaatccttaccttttgaataataagctttttttgctgtaattaatttggtcagtatgattgtacaatgaaacattattctcatgcgtttcacgagctagcaggagaatatattggactcatggtgtttctcaaagcagaaaagagaaaatgattactatttttcttttgtcaactttttactaattttctctttatagaatatgaaatatgaatgagcaaatactatatgattgtcataatcacgaaactttgatatactaatctaatcgtggacacaactaaataattaagcagttagttaaaggaacgtgtgtgatcaagaatgcttattatatgcaaataaaaatatatgactcatgcaaatgaatgaccaagaatgcaccacaaaagttctagaccggtcaagtatgttatctttttttaattctcttaatgaaacgaacgatacacgtagaattgttaactagctagtttagtcaatatagttagagagtagttaagataatagacttttaaaaccatagatggaacgttacatgtttccatggttagccattggaatattgaccgagagttaatatataagctattactgaatctggaaacaaattcttatgttgtcttaaatgcgtctactttaaaccgtacaaaaattcaacaaacccaagttaatgtaagtaattaggatgattgaatatgcgtttctatctcaataatcttcaccagttatatatttctcactctcccattaataacaaacataatcatctagataatggaatgtaaaaaacctgctgggtcagtctcccacacggagtcagcattttactcctccatttcactgattgacacgtgtcaattttccgacgactcttctcataattcatcctttgaccggtagacttcagtcaacagccccgctctcttctatttattactatgactaaactttttttagctttttaatttaaaacccaattttccatactattttttttttttaaaaacttcttaaaaataatttcataggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccggtaagctttacacaagacacatatatacatgcttcaatatgattaaagaaactactatatgaaccaaccaagtatatatttatgatgaggcttgtgtttggattctatgtttcttttggtggatgatctgattatcttatttcgtttttacaaacaaaatctctaaacagatattgacaatcataaaaatataattagttttttcatcgtcttttttctttatgatcacatattttttcattttgtccttgtgaatataatttatacacgcaataagtttcagatgaaggaagtggcggaggaagagaccagctaaggctagac

SEQ ID NO: 5067 - DNA, 2000 bp, Arabidopsis thaliana
atttttttggaagtgaaaggtaaagttgcaaaaaaatatcggtttcgaggtttttttttacacaaaaccctttattttaaaacatagaaaaaactgaaatgtactaagaaaaatagctatttataatttttggtcaataatcgtataaatttacaataatccatcgagtaaacatgatatatttagggtcctgctgcatatgattaaccaaagaataccaaaaataatcttctacgatctttaacatttccttttattttccatgcataagaactttttgtacctcttctcatcttttattttatgcttatgcaaattgagttaattttgcaaacgtatttttttgttccaaatattaccataatttgaatttttaaaacaaacacacaacaacaaaaaaaaaattgaaattccaagtgagaacatgtcatgccattgtcaaacatatcatataatgttttgttttttcttcttttttatttattatagttattattaaaatcccaatgttagtttttttttcggtcaaaaatcccatgttagtttgttattattaatatcatatattgttagtttgttctctttaccaatctaacatgttattatgtttaacaaacatagaaaatgatgttttgttatatattttcctatatacgtaacttctattaaaatcaaatggaattgaaagttattttgcattagattagttaattgaataaaaatagcatttatgcgtttaaaatagcatgacgtgttttcacttagaatcacatatctattttttttttttttttgcctacatatatatatcatggcattttattttaaacatatgaaatcaagtaatatttttagtacattggtaaataaaatataatagcatttattatatgttttatatagtagaatttcatctgatttaggctcacatatccattttaaaaatgttttgtaatcatctaaaaaattcaaactatggcatatgaagagtagactaatatagcaagttgaatcaatttctacgaagagatagaaaataaaatgagaaaagacacataaaatattaactgcatacacaattaaaacaaaaaaaaaaaacaagaaagagaggttaaagatggtagaaaattatttttgttcatgttgtttataaaatgatcattcacttcatatattccacataggtactatacattacattttcaactaattcacatattcattcataataatattatattaagagactaaatccaaagaaacttggtgggctattaattgactttaattttcttggcactccacaaaaccagaaaatgaaaataatccatggatcaaatgtttttgatttgattctttatttagagtgttcaaactggatctgttttctttatttcatgatttggttctttatttcatgagttagagtgctgttttctttatttggttctttatttagagtgttcaaggtggatctgttatttatttggtcttaatgttttttttctttctaaaacttaaaattgactgtgcaccactgattagtctgaatattacgccaccttaggtttttttttctcgatcataacaaaatgccaaaatcatgaagaaaaaaacaatttacagttgacaaaaaaaaagattaaaaatcaaaacagaagacaacaaaagaggaagcatagattcgtgtgtcctctggaccagataattaaaaataaatatccaaccgttcgttaacatattccatatcgacatttggccatttgggtcaaacaatacaaaaaccaaagttaaagaaatagaatttaatacctttccttttaaaattcccaaataaaaacttgattgaaacagtgttgacgacacggctccattaacgaatattccgtacatcaagcctcatacatttcccctgtctcttctcttataaggttttttctccctttgtttatcggaaaaaatctctctttcgaataaaaaaaaaatctcagaatccaaaa

SEQ ID NO: 5068 - DNA, 1868 bp, Arabidopsis thaliana
tagttaatactatgctctgttttccagtttcagaacaaaccatgctttagtttgcagcttttcaatgagtcacttttgttttaaaacttatcttttcggattgttatgagctatattttggaccttttgcgctattaatattaagtttgaactcaaccttgtttcttcagatagttattgaattgcttcgtagtatttaggggccattttgttaatgttagggtcttagggagatcacaacttctgctaaacaacagtaagataaatgtatcacttaaacatgtggtaacattctgattgatgtttcaaatttccgatctcgatgtcatatttcggtgtgggagacaaaacaaggtttatgggtttgctctagaaagtcttacattgattatggtgcacaagcatacgtgtctgctttaagaatactgaagtcatgttgatatcgttattgtcgctagcttcacgtggtagttgtggcgagtgttattttaaaatcgttagtagaagttgctcaaagattcttctccttggtgacttggtcaaacaaaaaatcctacaaaatgagaagaagataacaacaaaaacgacactgaagtcaatgtcgaaccaagtgcctcggaaatgcaactacagtcaggtatattgattgaaaacaatgtatctcttgtatgaaatcaaacgccatgcatgaatctgttttaagcttggggaaattataagagtaaatcaagaaaaatattctagatgatagaagcatagaacattgatcatgtaacttcatgacaacaagaaattgtcttcgaatcttttttgatggtttttctacattcaagttaaaaaaaatgtcatttgatgtgaaccggttcgacttagcatatggttaattgaaatccagcaaaataagaaaagacttgagaatatctaaagccaaaactgctgaattccaaaagccaaaataggtgttaacttatggtggatataaatataaatcatagagaaaattttacggagattgaataattaatacccgcaaaaggatcgggaaactgaatagcaaaaagacgagagagaatgagattttacttctttataattgaagttatgcgaatgttgtgtatttttacaatgaacggtttatcgttctttatatagagataaaaaaaaagataaaatttactgtgttggcatagtaacatttaaattttaaactacatcactaaataattagctttgaaagaatatatatttctcttagttttttttcttttctttttaagttattattaagaatgtggccaaatttacccaagagttaaaattttgtcccatcctttatattttaaggaaaaaattaatagttttagagattgatttttaccatttcaatttgggggaaaaaaataacaatctaaaagcattgaaggtttgaatttttgattcaaaaagacccaaaataaacgcctcatctttaggttaattttcagaataactattaaaaagtgaataattcttcactgatccatgttggactagtaagtagtaacaatcaaatccataacattaaatgtgttgaaaaaaagaatcaaaagtaacaaaaaccataaccctaaataatcatcccaaaagtggaaataataaaagaagcagttagattgtgacggaggagacaaaatcatcatctctgttcttcttcttctcctctctcacatacgatgatgacccaacaaccttgacgttgatttcgatgtcacacacaacactataaataacactcttcacctatttttgtcatctcacactttggactttggagcccaaaataatctcataaccattaaaaacaaatctcctccttctctccggcgtca

SEQ ID NO: 5069 - DNA, 2000 bp, Arabidopsis thaliana
ctaataatcgaaaatccattttagtagaaaacaaaacaaaacagaaaatcgaaaattcaaacaagtgacaaaaataatattacgacccgtccctttgtttggttgccccgttcgtgtatttgcttggccgttggtgttcccatgcgccacttagcctccaaagtcttctctctaaactccttttttataccataatctctgtttagtttatacttaattgcgctttatcttcttaatcgtcatgtaatccataaaaatcttcgagatatttactttctcgacttaattaattaatacaatttctctatattaaactagtcaacaatatgctcaatatcatatcatacatatatgttttagcccacaggattctcactctccattttcttattattacactgacgtctaatttgacgttgattttaagaaattgaagtcaatatagacaaaatctatctgtgaatatgctgattaatacccttttatgtaatatgtatgtacacgtgatgtacttttaatcttgagtcatacatctatgatattttgcattcattaacatacaatttcccaaaactatgagcaagtttacgtgttacttttgtctttaatcatcattcaatattatcgaaaagttcgttgccatatcatatatttgtggaataaaactaggtaatattgttcttgttttacattaactaatgcatttttttttggggggcacacattaacttatgcatattccaaataaataaactattttgtcgccgtgacacattgataaaaaaaacattctagtgcttcgattgaaaattcaagtttctccaaaatttactctccgctgcatccgcactttacaattgtaaaagagaatacccagtattttgcatagacaaatctattttttttttttttgatgggtattttttatatctatgtcgtaagtacgttacgttagctagctagaacattccctagcaagaactagtagtgagtgaggaagagaaaaaagaactcagcattgcttatacaagagtccatgtttgtggatccaagggaaggtttatctcagctttttttcctcaagagaaaggtgtatcttgcccgtggttactcgattgttgttcgtattcaatttattaaattttatagcttcaagggaaggcatgtgtttcttcttttttaagtgcaatatttttgtttattacataaagtacttcctggaagtttcgtatagactccaatagggtttctctgacttttccaatttcagtgtcggagtacattaactctaaagaaataaacatgcatgaacatgctttttcatattctacatatattttgcagtctataattggtttttccactgtggtttacgctaaaataaataatatgttcttgttaaatggccacaaacaattccgacaccataaatgtgaaacttttaacaaaactatattatcaataactagctaaattatgatcaagaccagtaaacatttcaacacttaacgtaaagaaatgaattggctattgacgatataatttttttccatagaaaactatgcatatgtttgtcacaatttttttctttctttgtattaaagttaagtgttgagtgagagaggtatcataatcatagtaccctcccacgatattgcccacggatcgaatccttagacccgcattttatttttaacttcatatcgcattagtatttaaaagcaaatatatatatcctatgaaataaaaatctcccgccttaaaggccaaaccttaggatctaggtaggtgggtccctctactcagcgaccacacaaactcacatttgtcaatttctcctctctcttaatttattaattattttatttactcatctctgtaacgccccctataaatacaacctctcatttactcattcagaaaccaaaaaatttcacaaaccaaaccaaaaccaaaaaaatagcttatctctctcttatcaccggttcaatcactaaacc

SEQ ID NO: 5070 - DNA, 1121 bp, Arabidopsis thaliana
tgaagctgacattgattgagaaaattctctgattttacttaccctgttctctctctttctgtggttttattctggttcaagtgaagaatgagaatgagacttgagtggtaaaaaaggagtcaactttaatttgagctgtcagagagccaaaacgccttaaaaataattttttattcggtgggtttgatttctttcctattttttgaatttagatagattttgccatattttacttctttccaaaaaaactctaattggtaacacatagctgtacataacttttatctgttaactttttttgaaatagtataaaattactaaaaaacagttatattaaaaaaaatgtataaaaaagctgagagaaaaatcttttagtaacgcttttgataaaaaaaattataattggtagaaatgaaagttgtacaaattatagtgctttgtttttttcaccaatcaatgcaaatgcaaaggtccaaatgtttcagcaaaatgaaaataagtggtggttatatcaaatcaaattttgtaaattcagttacatttacatgactaattttacaagatgtgtaattttaattatctctagatcatttgttttttttttcgatttaagtttggacaatggatcgaccaccaaacacatcatcattaacaaagatggaaaggcaagtccattattactaccgtgttgatacaaaaaaaaatgaattttatgatttctttcttcctaagatataatttggaatcatagtttaagtacaaaaaaatgtttccttctacgtgaatctttgtattacaactgtcagtgtcataaggcccatccgaaaagcccatttctaaatactagaattttaaaaaattaaacaatgattaaaaaaaaaaaaaaaaacaaagagaagaaaacaaaacagtagagaatgagaaaaaaccacagggaaaagcagagcactctttatctcttcttctctctttcttctactctgtgatcaaactatcgaagaaaaaacaaaccctagatttatccgcccctcttcttcctctgatgataagaaagtcgaagactttgagaatctaaagctgaaaaattttgttttttttcattgagggaatcgaatcgagtt

SEQ ID NO: 5071 - DNA, 2000 bp, Arabidopsis thaliana
atctacttgccaaaataaaacgtggggccgcagacgattacggccgaggcattataatttccacgaaccatcaccttgacatcttaaagaacaataattccttgacatccttagttgggctgatttgagctgccacccaaactaaatgatcgctaataacatgatttaaaaaatctgagggttccagtataattctttggtaaaatttggttatttattttatttttaaaaacttttccatagaaactatgtaattcgttgaaaactgtagtatccttttttattttttagcggagacggagttcgccaatagaagaaatccatattttgtaaacttagcgcgtcgagaaactaccaagggttaataaaatgcgaacagttaattagaatatgattaatggtttactccatgttgattgaaacctgaagttagtgtccaagaacccaaagctatatttgtcataagataagcataatattgttgatgacaaaaaaaaaagaataatattgttgttatttgatgaattatagttgtttttaatttcccaaaaataaaatgtgaagggtaattaaagccaataaacttccaaattactaatctccaaacacatgcctattatttacattctgggctacacaacacatgggaagtatgagtaattattgaatacatgtgcgtcgattatagtttattttgttctataatttttcgaataagataagtatatagttgttttcagtcgaataaactaacacgtcgacctaatcgtgtacctacgtgtttttgtttttgaccaaaataatgtatatattacatggactaatttaaatatgagtctacaaattacattacaattaatttaacggaaaattaataattaaggttcataaaataaaaaaaaaacaaaagatagattgaaataagaaaatacagccgatgattatgaatttaagcgaatattctaaataattcagctgttatacaaattttacctacgaaaagcattgtcgactgttttagaacaaattattctaaattaatattaaatcaactcacataaaaaattaatagacgctcgaacaagttaaatattttaagaaatcaaataagaaaatgtaattttttggatttaaaatagatcaaacccaaaataatatgaatcaacttaagaaaacataaagtcgaacgtcaaaaccaatataatatgaatcaacttaagaaaacataaagtcgaacggaatgtaaaatccattatttttcaaagtgttcacagttgaaaatgcatatactgtattaaaagtcattattgaaatatttgagcaatacttttatttgtaaatgcatctactttacaataaaactagtatcattgattaaataaagagaaatacatattagctcatgttaactccgtactaaataactagtatcatttattaactaaagagaaatacatattatctcatgttaactctgcactaaataagtatatttggtatatttcacatcaaaacgttattttcagttttcatatatatatatatatggcccataaataaaagatggattggttaaagttaaaaaccatctattatatttagccaggaaaaaaaaacatgtattgtttcttctttttgtatagatgactaacgaaaaactttctaactactaaactaataaaagttttgaaaaagaaaaaaacgatgactgcccaacagggtcatctatccatgatttaacatttgtttcataatgcaataaaaaaaaataaagtatatcttaaccacttaataatacaaagatccacttactaaaatataaatttgtctaataattcttcaaaattatacagtaatgacagctttaattaactgtccaaccccttgaagccctaatatatatacgtacaccctctcttcatttatcttcaccactctcttttggcaatacttctatcttaaaacttcttacctaaaatagaaatttgattttttgagaa

SEQ ID NO: 5072 - DNA, 1827 bp, Arabidopsis thaliana
gattctgccatatcaaagattcgaaagataaaacaccaagtaacaagaaagcttctatggtttctacaagtatttttaagcttttgtttatgatttttttcaatatttccaagaaaatgacacgactagtaaaaccattgtgaaacccagttttttttcacgcttgttgttgtgtttgaatgtttttgagacttttgtaaagagaaacagagaatcttacgatgtatcatggcttcatgattatggtacaagggatatttatcatgtttgtaacaaaaaaaaaaagcaagaacctttcaaggctcttatatatgtaaccgtcttgatcatatttgcttccttaaaagctctctaaattgaaccaaaaccaaacagaattgattcccgttaatgattgaaacaaaaaacatatcgaaccaaaaaagttcactagttcagagatttcaagtaccgatcaagattttttaccaaaaaaaaataaaaaattcgatcaagaaaattgaaattgtggactttagttcaaagattttcaagaatcaatcaagaaaattgaagcttctgcgttatcactaaaacgacagcgtactgacgagtttgcgactttttgcttacacgtatcgttggaaacttatgtgtggtggacacagtcgtcccttcgaaattgagaaggccccaaacaagcaagttaacgttatcacaatttcaaagtttgggctaagttaaacatccggcccattttaagctcgttgatatgatctaatctcgtaaaaaaagaataatgtaattttcctttaatatagacttatttactgtcgagaaacattacaagattaactatattttctttcaatcaaggttttaactttaaacacttttaatactaaatttgaaattaaaggtcgtttgattcatttgacaatattagatattttaatttttttttatcgtgtttctagttaggttatagttgtattgtatactgtaatttttatttgcctcgaatgaaaatatgaatatagtatgctaaatatcaactactatagttatggtgatgatgatgatgatgataaaaccacctacactattaagaaaagagagaattaaaagatagtcaaaacaaacacaccactaaaaatgcccataaaagtgaaacccaacacacttctaaactttagcctcaaaatattcttctctctgtctctctctaagtcatctctttgaacatcaggtcagttcatcttcttccctttttctcttatctccttgtttcttctgcaaattactttctcttttctttttcttataaatttcttttgctttttggtttttgtgtttattagggttttcttttcttttcttttcttttgtttttacttttcaatggtctttaatttctttgaaattttgttccctttctttaaaagatgtctggctttttagagatcaactcctaatacctttttattactctcttgctcgatccatacgttagaaagtgattatttgttcccactctctcagatcttttcttgattaatctagattcttcttatcttatacatatatagttccatgtatagatattctctatagtttttgtttcatggacttcaactttttatgttctctcaataagttttattaatttacttatttatttgtatgtgctactttttattagatccacttttgctagcatgcctttatatgcttaattcaatggtttgatcatacgtatacttattacagggattaattactgtaattgaagctcacatcatggaccatcatcagtatcatcatcatgatcaataccaacatcagatg

SEQ ID NO: 5073 - DNA, 2000 bp, Arabidopsis thaliana
aagattccagctcgaaatgaaagggaaacaaacatcttctctaacatttgttgagaaattcattcacttggcaatttgtacacatgtcaaatattaaatattatcttttagtttagtgatattctttgaaaaatgaaacgaatatcgaatattttgctcacatttttgtagctcttttagtttatagaaaaataaaaagagaaaggaaccaaatggtctcagggcacatgggccttacctgtctcggcctgtttaattcgataaattgtctcccaaatattataaaatctgttttagtaggaaatattttgattaaataatctggcttgagaaaagaaaaattaaataatctgactgagcattaatacataattctgttattagtgtttttctttaatataaaaaaataatcataaactaattcccaattcccttttaagattgtctctagtaaagataattctaaaatattataaagagtttatcaacgttagtcatttaattttggtagttggaggttaatttacgcattccaattttcaataagttggatttaaaaatacactttatgtctctgtctaagaaaaaaatacaccttatttctagtttctgtaaaaaaaaatcaattttcccacagttttacaaaactaaacttcattagtgtagcattcgagtcaaataaatttatatttttggttgacaaaaaaaaaaattaaaaaacaaaaaaagtgaatgaaacattgaaaactatgtttagtcgaatgaatcttacaccaaaaaaaataatgttcagtcgtatgaaacgacatcgtaaagctcctgcgacataactcgacgaaacttcccggcgtccgaatcagcgaattataagactgcaatgctgggatggagtcttccgacgattgcttcattcaggtccgttaattcggacgtgaaagtatcttcctatttattctattctttaacagatcttgattaaaatgaagaaagagttctgattaggataaaagaccaattttgattaccgaatcttttgtgtgtttggtatgattgtttgtgccttagtgtgttttaacatatataagtttggtttgagcttgaagttagtgtaaggctcggtgtgaacgatttgttatcctttgaaaattatagaacctccttcccctgggactcttattcaggccttgacggattttttcatcttggtgcagtggatgatgaaggtaacttgactgagataggccagttgatgaatctcgaggtctaaacctaactaatccatatatatatatatatatatatatgtagtctctttgaatttctttgcataaaatttcattagatagacactcaacttcattttgtacatgcttaacttcaagattccaacactaaatacaaaatcttacgggtccaaaactaccttgttggtacataatgtacaagacaaacttgttgtccgtggaaaaatgttgcatatataattacaacatcagcttgtacctataatgtttgtgagagacatgcatcaaagttataacatgcagatgtgcattcatgtctttttgagttatataaaaccatattatttgaattatcggttgacgcgttttataggtaagtgacggcttgagagaatctttagggacatgtatccaagtttatatatagagttaaagtcggtgacggtggctccaatctattgccgcgtaattaaaggtcagtctttttgtctcctccttcgacgtgcttatcaatatgtcatagtattaaacttattaacacaaaaattgattgattacttgtaattttataacaaaattagatacgacttctgagttttttttctgactgttatttttataaagaagcacatgggagttcttagatgtcacaattagtgaggtggggtctcttttcccatgtgctaaattatattttctcccaacaaaaacctctcaaaattttcaattttctcaaactcttgaaactaagaaaaa

SEQ ID NO: 5074 - DNA, 2000 bp, Arabidopsis thaliana
tttattgtttgaactcactaatgtcttcgcttgaattttcctgccgccttcttctttgttactcgctctgttttcttcttcatgaaagctctgtttcctcattttctcctttaacactatgacacacaattttttccatctcctctataataaatactttccaatttttatcctttatctcatcgattaaaactatcaaatcgatcttgttattgcaccttcctaattcaaagatgggtacgcttatatttttgtataattagcttttatttcgaaatcaagaaacaaagtttcaattttggttttgtctatgtttccatacactctgtttttttcctctcttaaatgctaagcttaaaccaaactccaaaagcatttacatctaaacatggcttcttccgtatcatgcatgatatgtgttaattaaattttccaacatgctttttacataattctccttaattaagactcttggtctggtctctgttttgttattaaaaatcttagtttctggtttccatacactctgttttacctctttgtaaaggaagcatctagattgttccgtttcatgacatgtattaattaaattttccaacatgcttgttatagaattctccttaattaagagcctctaattaatcatttctctagtttttaaaatatctgtctccaattctcctgcaactaggatttttatatacttcccgttgaatttcttagctactagtagtattatttttggttcaatttttgtcttcgttttcttattttacattttaatttctgtctttcttgcttgttgattggacccaaattgcttaagatatattattcgtcattatttttcattaatttcgctttcatttacgcgcactaatatcttgcttacctctaaatttgcagatcctcatcctttataatcctctagattgtggttctagacattttacaaacaacggtggcggaaaaaacggcagaacgttctattacacaaatatgggcaagatcttgaaatctaaggtacgttctgtaaacaatgaaactacatctcgtttattattctcctttactttctttgctgaaaacggctccgtttaacagtcttcttggccaagaaccgtcgtgaggaaatggttaaacctacgtagcggcgcttacgaatttcactctgattacccagtcaaaggtgagatattaactcgtgccgttttagatatttttgctcaaatttcttgccgtttttttaatattctcgtctgacttaccggaggtttttttttctttctagggatggagccaaggcgaaaaagctgctccgacatgatcgtgccggaaaattttcaaggtaaaaatataaaaactagctcatgaatttgatttaattatactactattgttttgttgcatcgaaaacggcgtcgtatctattgtccgtagaccgtactgaattgagactgtctccgtaccagataaagctttgggtccatctctaaccgtaggattagacatctgtgttaaaaacgacggcatataagaaactgagattttctcttgaaaatcgtgttttttttgtcggaaaaaaaaaaaaaaaaaaaacgagtttacaaatgaaaattgtatcatctgtatccacgtgtagggtgagagattaggtttaggcggtaagtttaaaaaagtctttggttttaggtgtacttgccactctcaccattcaccagtttttgttttatccacataatatctctgtctgattataatagtctaaatactaattaagtgaagtatataactaattggttttgtttatgttttgtggttgaaataggttggttgggccaaggaaatggggatttaaaacattcaaccggtgaacaacatgtgacacgcgttgatgacaaacttgatcttaagtaataaatacttccatgattaacctataatttagctctggtctataattagctatgatcattaacgtcgtaattgtttaattgttg

SEQ ID NO: 5075 - DNA, 2000 bp, Arabidopsis thaliana
tcttcgtgtgagactgtgtagattaacttatgttttagaaataattgttatataagtctgccccgtgacaaacggattaatgaaggataataagatatgttcacatggccaacgtgaaagcataaaaaacaattatttatttttagatatattttaattttaatttgatttaaatattgtacctggttttcaaataaccacatctaaggcgttagctagtaatttatgtcattgaaaaaagccagaaagaaacaaaagaacattcttcatgtaattggcttctgtgaaaaatgaatttaaaaaaatacttctaacaagttgataaataggtctggacataaaaatcggaacccgagtactctaatcggcgtcaacctaacattttgaactgaatcccaacccaaaaaattagatttatcctactaaatcctatattccttatttcttttacttataatccctaacttgaactccatctaaatctgaatctgaacatactctcaaaataagtacatactaataactttagacttgaatatccaaattttttacttaaatacccgcaatataagtacatacacaaatttttatccaaaacctagatatttacctaaattgttttgggtatttgcataatattttgagtatttgtgtacccaaaaagaatcgggtatttaatagttctaaaaatttatacatgattttatccaaactcgaaaaaaccaaaaccgaaatcgaaccatttttatatttaccctattagattttattttatttttcctatttcgaacacggatggttcctaccagattctgccttaagtttcttaatgttcagacctattgataagtatgagttttatcaatgagcatcaagtaaaagtgagagtcttgattctgctttaaaacatgaaagtttttattgtataatatggatatcgaagaggctaattcagatatataaaattacataatacctgatttattagagtccatataatttacataagactttccacgactaatttatatagttaaaatactatatttgattatatttttagtaatcgtgaagactcgttcatatattgatatacagtataacctctataaattaatactctataaattaataacctctataaattaataaattattccggtcccgagttaggaccagtgtaaaaaatgacataaatcgataaattaataagataatattttttttgaaaattctatgtaaatctatggtcctatcaatatcataaattaataattgtataaatgtatcaactatatatatatatatattatgtaaaaaaattctttataatatatttattatacttttttgcttaaattcatatttgttctttgtttgattatagttttcatattttactgtatcaaaacttttagtgttgttttctaaacattattattatgttttacttgtaactggttctagaaatatatattctataatgaaggaaatcttatagaaatttttaaaatgttaccaaattaggaaaatctctctataaattgataaatattaatttatcgataaattaatacctctctaaattaataaaatttcgcagtcccaacattactaatttatagaggttttactgtaattcgtaaattttgagagtagtttttaaccaacttacaccaccaatttattagagtacatattttgattttcgatatgcaatcttgttaccaactaagttgttaattaggaccatatactcttagaaattgccagctaatttgaacaatgaccatttaagtgttttcaaataatcaaatcatatccatataaaaataattagtcaactaatcccctattaagaaaaatcaacaattaaaacattctcatttcctcctaatgaataccctataaatacccactaaaaacttacatttctcccaccaatctcaaagcaaattaaatacactactacttcttgagcttttaaactacacaaacaa

SEQ ID NO: 5076 - DNA, 2000 bp, Arabidopsis thaliana
gcgattttttgaacaaggaatagaagtaatgagaacattaaattgtttatcaatttgaagtaaccacattaggttttagtttaagtgaactaaaggcatcggtaggtcctatttttgtgtcgtattgtatgttccatgcatgatgcatggggctatatatatcgtagtcaaacaagaacctaatataatcaaattcgacccatgaggttggtatataatagggagcaaaaatatgaatcttcttggattaaaaaccggtccaaaccacgccttatacattaggagttttatattgaataaaacgatcggattacttgtaatatatgcaacgactgcatcactctcaggtaagaaaaaaacgtagatacatcgaacatacatcaaacgcagacgcgttcactaaccgcgattcaaacacgcacttgatcgatctaggacataggttaggaggcgtcgactcacgtgaccatgtctcttccaaagtcaacataaatgtgccgcgtaaggatagagactacttttgttgttgttttactacgtttctaattttatactaaattttacgtgtttaattattaacctaatggctaaatgtctctagttattaaccaattaaaccctacaaatcgagagaccacgaaacgacagagaaaccccttaaacactttgacagagacaacgtccaattattaattacgttgaattattggcctttatgccttaaattgattctcttactacttcttaattttgttgacctaccaatatatatttacaaagttgtatcatcgggcgtttaatgttgaaacccatgctactattattaatctgcactaccacgtaaattttgcagtaagagctaatgaaacaaaaaaaaatactattgactaataagtaataaatgaccatagctcaatttgtttactaaatacctcaacttgtagcattattctatagagtatcatatagtgttaaaagtgtactgatgcacgcaaatatgtcgttaagttaaatgatacacagaaaaattgctccacacttgcaatacgaagtgttttttaattataatccaaaattttgttggtttgtcctcattatttaatatctaacacttgttatttgggtctacacccgaaatttacaaactaatcgaattatttcccatatgaattataaaatatatatgatggaaataagcaattaagcatgatcaaatcatcatcatatttggatttattaagggatagacataaactttaaactaaatttccgagtatataaaacactaaagtataaaatcagatccgtgtgctgaaattattatttgtgaaacaaaattgatattttaatgaataatgatgtaataaaggttttttttttttgttaaagatgtaataaaggttatgagatgagatcattgataatttgataaacatatgtctacaatatttaacataaattaactaaaaatggatatgatagagaagggataaatttataatttatatttacgaaatgagataaatttagacttgtagctatgcttattggtacttaaaattaacatacatttttcttttaaaaaaccccaacattagctttagcttctcgaccaatgatgaaaattccaagaaaagaaagaaacattcataattgtttttttttcaaacaaaaaaaaagagcggccgttttattataaaaagaagataagctattggaggttgatacaacgctttttgtctcatctccttcttcttctccttctcaaatcttttttttcaggcgtaacgaatcgaatcataaacacttacgcagaaacaaaaactaaactttggatcttttaaccgaccatagagattcgtgggttcttcttagtttcgacagattcttgatccgttttagttgttacgctcatctttgcttttatacatcagacccttctcttctcttccttctttatctaagaaacattagggttctttgaaatcttgctaaaaaaa

SEQ ID NO: 5077 - DNA, 2000 bp, Arabidopsis thaliana
tctaagcccattaacaggcccaaaagtttagtttatgtcgtcactcatgacatcttaatcgattattttggtgtaaactaattgagcgtcattaagtaaaggacaaatcattaaacgatagtgcataagattaactaaacccaagttgaagaataatcagagtgtaattaacaatagtatcagtagatgaaatcattattgatatcatacaaataaaaaaagcaagagacagtatgtgagagcaatgtaaccaaaacatagccacgcgctctcgactgtgaggttccccaacaggcctaacattgaagttatgtttggtcggtgtatatcacgctccgtgagagaaatggttactgagaatcaacttctgattagtacaagattatggttcttcagggtcaacacaacattaaatccttataaaaacaaaagtacaataaccaaatcgaatgattaaacatcacttttaacaaacatgtgttcacacactccgtggtacattaagaaaaaataaattgatatacgtaattaagacattatccaaattgttaattggacaaataagacatttgagactttacgaaatggtcccaaacaatttagtaacactttctcgacgtttacgaaatcttcttcaatccttaagttttagtgctaacttaaacttgttttttgacaacgaataatttatatattaaaaaaattaaccaattggaaatggtttctcctaaaatattagttttgcttcgtaataatctacactcattggggatatcacactcattgtatatgtgaggagaaaatattctaggattctttctgagatggagatatttatatattcaaggtttttgtaggacaacgaattagaacctgagcacttgatgttaaaaacaaaaatatttgggagataaggtgaatttagacactaacaagtaacaagtcgcattcatcttgaatattcctctttcttccactttcacctttatattgaggcattgactctataccaattgagtgattgatcactaatcatattataagaaatactaattatataccatgtcacgactgtattaaggaatctaatcgcgtcgtcttttgaactttgactgttcaagaaactatagactgagtcaaagatatgaaatgattttgttattgccgacaaagattaattgatttattaataataataaaccattaggttttggtatccacgttcctttcacccaaaatatttgtccaattccttggccatcaagatttatctttatagtttatataataagatgttataatacagtattataaaaaagacatagaaatacaacaacaacaaaaattagtgattgaaaataatgtcgaataccatatctaagtaacagaacctatatgttctaagttccactactatctatccaaaaccacataaggaatcagatgcaagccaatatacatccacctgatattttatcaaaatgattccattggtgaaaatgtttattagaaaatatgtgagattggatgatttttttatattttaaattcaattctcaaagctgagtaaaggaacctgacttttagtcatgaccaagcaatgcaagtgggaagatattagataagtaaaaaagataacaacacaagaatcaaactccaaaaccctagagaagtagttgcagatagatccgacacaaattaactaacctcttaaattatgtatgttttaataacttgatccactttttgtggctgcttactgttttcctcgaaagttccatttttttcttttgctctgcaaacgaaaaagaaccataaatttttctcatatttaaagctctctctttctctcacaactgtgttcacatgaactttctcaccgctttcttctcttcattgaacaaaaaaaaaagctcttaacttttttttcttctttaggtaaaatttgacaaaagctctcaactttcaaactctgtttcttcatcatcatcatcatcacc

SEQ ID NO: 5078 - DNA, 2000 bp, Arabidopsis thaliana
tttttagaggctacatttcctatggtttgtgaccagactatagctagctacaatttttttattgtatttttattgcgaaaaacttagttgcatatattattcactaaaacagagattttttgtatagtaaacagtgaaggtaaaattgttagcaaacaaaaattttgtagagtcaagaaaagaatttttatatatatatatatatatattttttagaaacaacatatttttaataataaaaataggaagcttcaaatacagcattgaaaagagtttaacgaagaatttttgttttcgattgtatttaaatttatataatatatacaaacaaaaaaaaaaaaaaaaaaaaaattgtcacgtgtgcgtttggtagctgtaaatgaatgcatcttacacagtagcccacatgtcgattttggtttttcttcattttttcttcaccacatagctgttgtcttcaaaacaatcaacgagttttttagatttgttgattttgttgttttggattattgttgattttgccattttagatttttcactttatctataaaaaaaaaaaaaactattttctgccacttaaaagctaaaattttgagaaactttttaaataaaaatatgtatttgagaattttgtttcattatgtttccattttttttttataaaatacataataacaaatattataccctaaaaaaatagaaccaagtaaacctaaatgtgtaaattgtaactttagatataattttttcggcaaatctatgaatgccactaaaaatccttatctggtaattgattcatttatttatttatttatcacactatatcacatcatttacgttcacaatattcaacatattaggcggacaatttcttttgtcaacatcacggatctagtatttccttttgacatatctcgatctagaagatgaaagaaatagatatataggatgaaatgaatttaataccatctaaaagaacgttcctattatatatgctaatgtatagcatcaaaataccatttgtacaaagaaaaacaatagataatcgaatttaacagagttagattgataaatggtatttctttagttgtcacgttttgaaagcgtgattctattctcatgtttaaacatttgtcttaaacgttttgttatatatcatagacatgttagagatataactgaaaaaaaatcatttaaattagtttttgagtattttataattattcttttgggaatttcagtcatccaaaatcattcaacaatgttgcgccaaacagaagatggttcaaccactataatcaaaccatttttcaaatgatttcgttttttttgtttattttttggcttttgtggattacaaaccaaaacaataatttaaattatgatgatctctactttagtctatataaatacaatgaccatgaaaaaaatacactatgggtttggctgttttcgttccaaatgttggcatgacctccaccgataatctgttgttgattaggtatttttaagtctgtcaatcgtgaatcgacatctgattgtcatcaaactcttattctataagatgcaaaagtagtaaagcataatcatttattttacataaacacattgtttattacttttgtacatgttgcaaaccgtcgcacggcgccgaaattcgttccctatctccttcacttcaaaagtcactgaagacatcaaaaagcaatattgtcgacatttatccacaactcttttaaaaacgtgtcttattaaatttatcatccaactagcttagcatgcaaggttttattatgtcgagtgtcgacctcaatattcaatagaaaaaaaaggctggaataaaagaatatcatcgtttcattttggttttacaattttccctatttatatccccactcgtccttgtttcttccaccatctacaactttcattcttccactacatttctctccttgagtatcttcttatcctattttccaaattccaaaacaattcacaaa

SEQ ID NO: 5079 - DNA, 2000 bp, Arabidopsis thaliana
agacactaatgggcccgtaaagtatatgggctgaaatgtttcgtaaacaaaaatatagatatcgaaatggtgtgccatttttgggggcctaaattggtaaaatgtcaagtggaaatgtggaattcgaaaaaaatggcttgtttttcagaattaggataagaagtccaaaaataacaaaattccattatatcagttaatctgtttttcctcatgtgtatcactacagagagatagctgtatctgtcattcaatgtgatttgtaaaaatgatagataatattttagatgtacagtctagttgagaatgtactatttttggtattatctatcgtacgactgcaggtttctgcaaaattctcgctatacagaaacgattaggataaaaatggatgtctagatcaaatgtcggagaagagagtcgatcactgtttttatcttgtttatttatatgatgcatgaactgcttcaaatgtgaagtaaattgttcacgatgtttattcccttcaactaaatgcaataataaaacagagagaaaaacatgtagacgataatacaaagaccatctcgtttcctacctacaccaactcatacctcgtagtataaccaaaaagcaaataataattaggttacaacaaataaatctcatgcctcaacgtccaacgcatatcgtggcaatttcttttgttatcgctttgtcttcaaggttgttcatgtggccctaataagataagtccaatttctcttttgtttcatatcttttgtttctttctattaatagattaatgcatgttaatgcacgccacatactatataaattaatttttgattatagtattccttatttatttcccgctacgaatctcttaattatttgaattgattatcttccgaaactgcttcgaaagacttggtatatattatgaccccagattcttttacaacaacttaccaaagaaaatgaatccacctagatccccataaaaatatacacaataacctgacctggtcagaaattcagtaacaaataaagagaaattgagtctatattatttttttgtctttctagtttatgacttttattatatcagatgatccaataccactataaatttgtggtaaatattttttatttctcatgataaagtgccaaaacaaaagatattgagaaaaattatccaaaatttgttttttttttcctttttagtgtccagtttcaaagctgattaatattagtataaggaaacaaaatatataatgtctgcaatcacttgatctccaagcaaacagatcataatttcccaaaataaaaacattcttaattcaaatcaagaggagataaataataacaatcaatgatctttcacaaaaactttaaaaacattccgattacatcattaccataaaattcataattatcatagtgggtcaaaaggagtgagtgacagtactgtgaccagtctcacgtgagagaaggcccgcccatttcttctcattagcgcgcatgaccttcacgaacacatataggcgcgtgtcatggtacaacaatagtcaaagttacttgtaaaccaagctatagagtgaaccaaaaccgaagctcttgaataccgaaataatccacgtgtcaaaaatcggagaagcggctagtcgtttgaagcgcccactaatctctctcttaattgccttacttaaattttcattaacagaaaacataattatgatacggctaaatctcggaaattccataacgataatttcgaaaatcaagaaggaaagtaagaaaaagccaaaaacacaaaaggaaataataatatttttgaaaaatgggaaaaaggaataaatgaggggggggcgtgactatatttaacaaagggattgttactaagaaacggcgttttcttcttccttcatagatagcctttttgactcttctttctctcttctactttttttcaggctctctctctatatctctatcttcttctccggttaactaaaagagaa

SEQ ID NO: 5080 - DNA, 1060 bp, Arabidopsis thaliana
agaaagaaagcaaccccctcataaacaaacatgcgtttcagatccattgaataccgaaaagcctttttatatcataattagcggcttattatctatctcactgctgacattagaagcaaagttaatttctgtttctctggataatttatacacaaaagttttgaaggtgaggcatcatcactcgtgctagctctaataatatcagtcgactaatgttggccatttggttttttctttgtcattttcatttatgtgaataaccatttttcttgggtttagagtctataaaccgtttggtaagatgtatcattcgtgaaacctcagcacataccaaccttaccagagaagagtaagacggcattatattataaaccgtttggtaatatgtatcattcttcttctatcacaaaaaaggaagaaaatcctatatttttgacaattgtctgaaaatacgattaggttcagagtatttcaacgttgtctctgtcatttgtctatcgcaatttcgcataaaagcaagccttgtaggtgtagaagccatcacaccagattgtagtggatgatcggaaactaagacttcagtcatctggtattctcctctctctctctcgaccggtcctcactataagtcttctctttgtaacatttttgtgatcattttggatcgttagttttgtagttgttctttttttttatgagtgttttgatagtgaacataaacttgattcataagtcaactgtatgctcaatcaattggtttttgaagaagttagttctaagaatcaagcaattggataagataaaatcagataaaatctacacgccttttatcaaggcaaagcttatagtgtttaaagctgttttccttgaaaacttgaaagatctacactttcagaaaaaagttgtaaactgcagcaacccataatcaataaagaaccagtagtagttttcttcagttatgcaagcaaagattatatgaattagcatggctatttaatatatgcttttttccttgagcagagactttacagtgtttgaggaacgaagattgtgagacaca

SEQ ID NO: 5081 - DNA, 1125 bp, Arabidopsis thaliana
atatattgcagtttcagtttagctccttcaatcttcagagccaaaatacaatgtttggtttgatttataagcagaacaattcacaacataataaacaacatttgcgtgtgcttagagattaaccagaaacggcaaatgcaggaaaaattcctagaaaatgtcaactacttgaaaatgatatatgaaatttaaaattcttaaacattcttgattagttgatgtaatgcaaataatatatcaaataaaaaattaattgaaaaattgtgacacacctagcactaagttttttcttttcttctgatgatgattagaaagagtcaataagcttgaccattaaacaaacagaaccttcttgataaaatgctcgaattcaaaatttaagtaccgattggtcctagaagaatctgtaaattaaacagctcttggtaagaaccaaacctagctttcaaaacatgaaataacaataagaaacctttttcgattgaacggcgaaatatatccattgaagatgttgagagtgagaatcgaagacgaagaggtgcaattactcgcagtttttttttttttgtaagttaattattaatttttgacttcattaaagttaattatttgctgaaaaaaaaaaaaaaaaaagttaattatttagtatcttcaaatataatatttaaaaaaatctagccatcttaatgcattttaatgaaaatcctacccaagttttttaaaggtcaatttaaaaagtatcagttttgatttttaattatattcaatatttgttaaattttgtttcatatgttaatattaaaaacacaatctatttcctaaacatttatatacagatcttttttaaaaaaggttagtcaaaaactgttggaaaagctaatctttttttaacaaaaatagtaaaatactcatatacgtaactttgggcctttcttaaatggctttgggcctttcgtaaatgggcttatgggcttaagtacttcaaatctgatagtatttggtttattgcaacaaaaacaataaatggaaatagcgatctgagctgaccaaccacagtcgcggacagagctaaaaccaccatttgaagaaggagaagaagaagaagacgattcggtgaaagcgaag

SEQ ID NO: 5082 - DNA, 2000 bp, Arabidopsis thaliana
tgttgaaaaaagtttttatgtggtgggtcagcactcagcagcttagatatatatgcaatcactttgtgcatcatgctatgtagattagctaactctcggcagcaattcatgtaaaagtaaaatacgagtgattggtacattaaaaacttcaccatcctcttgcccaatgttggatttctgcttagtcctcaaatcagttgttggatatccagtatccacatttgagtgccatgtttctgcttaattagtcctcgaattattttattgattttgatgttacacaatatttttaaaaatgaggaaaaatacaaatttcaaaaaatatctgatataacctggtttctcttttctttaatgtttcatggttgtttgtttattgcctttacagagaataaaccaaagagtttattcctgcaaataattaacgttagttgtgttatacacattcatatgaatagtgaatcttctgcagtcgcatgtgtaacattcaattgcgcaacaaaggtacaaaagcccacttgccctttttaatctcttttgaattttgatcgaccctggattttgatgaactaaattcctaaaaccatttgtgtttaataaataattttctgaaaatatatcagccattgacgtagtgacacgtgtaagtgtggaaattggacaaaacactttttaacttttttttgatgtttgtgaatttcattgtctctaattatgattacaacgcagcattctgacggtttgctccctcttacagctagaccaccactaccttttcctaaacgaaaaaaaagagattacatttttcattttaaaaaaaaaatttcctctgattcatataaccaaaaaaagaaaaacataaaaaacgtctctacctaattttattcctaataaatgacctgaaatgcaatagctttttaaaggctatgattggtcaaacgataacggttgacattttacgttctatgatttcttgagtggttggtaatggactaatggtatatgtatcatcaggtattgagtatatctctatatatatgcatcttcatacctgcatagcattgcagaaaatgatactaaataaaactattagcataattttaagcaaaaatttaagccttattcacaccatcattttactttgagactccaaatgattcattaaactcaaactccttttttttttgtcttgagtgtacaagtttagcaaaaaacaaacaaacttaaactcatctaatatcctatgtttttggagagttaatgaaattctaccaaattttatatgagataacatttacacaaaaagtacaatataggaatatatagtagaaaatccagataccatagtttaagatataattaaaaaggataattttcttgtcaaaaaacagaaggcatatataagctggatattaatatactaactatcatcacacccaacgaatcctatgcgcgtgtgaaacccacgatccaatcacgaagctaaattcttcagcttcgttgtataataaattgttaatcacgaccgtcatattcctattataccctttgacagcgacacactctctctccaaccaaacatatctggaaactacaaccacgcgcactcataagcgcgtgagacttctatttttctcttttattcactgacaataatcgttacaactttatctgcttatcaaataaaagctaaataataataaaaatatttttatatctgaatacttcccaaatacagagaagccatttcaacagaaaatcgacacgtgtccatcagaggttcgtcttctgagggtaaaattgtaaactcacgttgtctccttcatcatctctctcttttaagaatttccagagcgagagagtgagaaagagagagagggagaggtgcttttttagtcgttctcgtcgagagacttatttatacacgaaaaaggaagaagaagactgttgaaagcgagagagagagagagagagagagagagagagagagagagagagag

SEQ ID NO: 5083 - DNA, 857 bp, Arabidopsis thaliana
tttttgcagataatggagagcagtcaagagaccaaccaaagtagccataatgagatctcctataggaaggtcaggatttcttttggtttctcagctttatctttcttttgtaattgtattattatatccagacgaaatctgtgtctacacccttttttatgtcttattagatacttttgtcttcttccaataatactattaagcatgtgattgatgttgtcggaacacctcctattatctccagtatgggtttgcctagattttctcctcccttgtttttatgtatgcaactagacttttttggattttatttactaaacatatgattcagtttttcttcatgtaataaagaaaaactgttaaaacggccttcattgcactgaccaggtcgaggtgttattatttctgacagttagttgttacttggactgttgattaaatttaatgacattaatagatttggaaaactattacaacgaccttcgttgcagtgtctgggaccgtgaattctgatgcacttctcgatttgtctatcctcttaaagttggtttgtcatttagtgtctgaaattgtaagattatggacccttctttacaagtcctccaccaattctgtctcatccatttgtgtggttagtagcttcaccagcttaacactttcactaatcttaattcttaagatatgaaaagcagttgaatgaatgcattggtaatttctttcttttttaataaattttctttttgttggttgctaatttatatatgtaataatcttactctatataaacaagttccttcaacacacaaaaggaaccaccaccatattgtgtctgtaaaccaagctcctaactctctcat

SEQ ID NO: 5084 - DNA, 2000 bp, Arabidopsis thaliana
acatcgagactttaataatttgtcgagcaataaataagtatatggtaaacctccacttttaagctagcttttgggtgtgagttaggcccatactgatactctcagtctctcattacattaaattttacttagtttttgtatccaatatatttaaagtttatatccaagagatcactaaactcaaggaaaatttaacaactagaaaattattagaccttatcatgaattctttccagcctcagtaataaaacaaatgtcgttacagagagtcaatttttgaactggttttagattttgctcatacatccaatacaatgaccttcacatgtcctagtgatgacatgtgatataagtcactgagtctcacatccacgcaatctaaattatttctttaattctagcataaagatcctatcctggttaccaatgggtttcaaatacccaactgttgtttgaactgtcaaaatagtgtcatcctttagatccctaaataaatataatggatggactactcgaccgttaaaaaattcaatagataaatcgaaccatattcgatccgaattaccttttgttatcttaagctttttttttgtttttttttttggcattttggacctttaaatttaacaaataatcatacttataaattatctaagaacaaagttgttatagttaaatcatttatgagtagtaaacatattcatgacaatgatgtagaaatatttatacatactcaatgtaataagtgaaataaaaattcattcaagatcaagaaaaattaaaatatgaatggagaatccaataccaactagattaaagaacaaggttgtaaaacgattcatgagtagtgtcacattcatgaaattaatatataaaattttacattgacagaaaaaatataaaaattaaaaaacaataaggaatttaaaaaatatatactcaacatgtaatatatatatgtaaaataaaatcacactaaaatggtatcctcgattgtatagaaacttccaaatttctaaacggatgcaataagaacttacatattctctttcattagtcatttattggccagatttattaaaaaaagttttactcaatgaccaaggattagagttaaagataatatagattattacatatattattcgaaaaaatatacgcatgtccgactttttaaacctcaaaaatatcaaaaccagaaaagatgataccacacaaaaaaacaataaaataataagtggaagagatatcatcggacaacagtacaagtacagcaccagctctgccaaaagccaaaaccatttgtcaattacagaaagatactattgtttgcaattactaaattacccctcggactttacaaaagcatctctaacttatccacgtgtcagtcatctattgattgtttcaataccaccttgtattaacgccccacgattcgtggttgggtacacctgatagtccgaggatatttaaatctcacgcgctcgtgtctataattcgactgtactcgcttttcttgtcgtgattttagcaatttacgaagtcaaatgtttgactcaatcagacttgcgcataagagagcgagtataaatgtttactatactcacgcaagtggggctttattgaaactactcttttgtaataaaaccagcagtggttttgttctgaatccgctctcttgccatatataccacaaacagaaaccacagaagatatcttttgagaaggaaaaaaaaaaagaagcttctcctcttcctctgccttcttctttccatttattgcaaaccctgatcaagtaagtcaaatcttcacgaacacatatgtatataaattcaatccaagaaactaggagaaatctatgaaagaggacaaatctaagtcaagtttgaatcaggaagattatctagatttgatcattttgacatttacgatgtgcttacttattcttgataaactttgatgcagttggttttggtgttagtcttttggggagagag

SEQ ID NO: 5085 - DNA, 360 bp, Arabidopsis thaliana
attaaagatacttcttgcctacgaaaatatttgatttatatgcttgcatcgttttttatttatatttttattttttaaagtttttcgaaaaatagaatgacctaatatttaagtaaaaagatcaaaaacctatttgaaagttacagcaatcaaataacgtggtgtgtctggagattgtaaaagccaagactagaaggaaataagaataaaataaccaaagtgacctcagcagtgacttggttaccttactgatgtctttttttttttttttatcttcaagataagcttgagagttgagactacaaaaaaaagcacaatattgtttttaaagtgacagagagagtcagagagagagatcta

SEQ ID NO: 5086 - DNA, 2000 bp, Arabidopsis thaliana
gatgatgaatttatgatcaactaggtacattggacatgtcgttatccttatttcaactgacttaacgttaatgacttattagaaaagcccacgtgacgattaggctaataggtttataaaagtcaatttcgacagagtatagtgtcagtaaaatatctgagatttacgggtgaaagatactatttatggaatgttcacttatacgaagtccttccgtataagtttcttattgactgtgacatctattgttatatttatggaactttagcgattaattttgtggacctagctaactaaagaaagttatatttgttggctcaacgaagtcgtatatttaagttaaaagattcagattctagagtatgtaaggtattataggctgttgattcttgtttttcagttaacaactatatactgtagtgtgtataaggcaattacaaattacttgattctaagctgactactttttttggttttgtatattttagaggactaaatggtgtgattatatttaatgaaaatatgatatcttattaatgcttttaaatacaaacaaaaatgtagattatcgtacatgggaagcgtgatttccaaagcataaaatcaaattgcgaataccttttgtatttgcgttcacaacttacaaacatttcttactaatataaaaacttttatttgttcaatgcatatacaaagttacaaacgcaaccaacatttgattcgatcaaatttctagagatttcaggtaccgtacgttggcaaagatggagaaagtagttcaaatgtcataaaaaattttagcgattaatatttagctcaattttttatacgacattttgaaaaacaaaatcttatattttcttttaaggtagaataagtaatgaatttccagctttatgtagaatatatgcataatttgaaaacaattcaaggccgattcaatgtacttagtaaacgtttttgttcttcttcgttagtggtatgttcgtaaacttgatgttaagaaaagttaattgatctaatctactgcaaattattcaataaaaattaattgatgtgaaaatatatctagaaggaaaaaattctccaaaatgtaaagtcatgtcaagaacttagacccccacacgtagattctgtattaaacaaaaaatttattatggtccaacgaaagcttctgagtcggttttgagagtcaacccacgtgggcactaacgaagtcccaagtcaaacatattcctatgggtcctccaatcaactcttttattcagtacacatcatatttttggtaacataaaattccattgctgttgccaaaaaataccatacaaatatagttttctataataattagttcaagagactgtctaattttatcataaatttcctactttttgcaaaagttcaacttgagttaaaccttataagctctatttagatataaatatttaataatttagatataatgtaaaatataaacgcaaaatataataatttcaaggatataacaaaaaattgttttatatttttgttgcacatgattcttaccatattattaatgttgtacatttccgaaaccccatacatgtatattattatagccataaaaaattgtacatatatgtaaaatacaaaattctcaaaataaaatctattataaaaaaatgaaaaaagaaaaagaaaaagaaaatttattttatgagaaacatctatgttgaaggagaaaaaaggtctaaagaacatctacataattttcataagtggagtttttcgaacttcgaatattaggttgatggacccacttgtttccttgcctataaattccacaaatcaaatctcatttaatccatgcaaaattaaaacacacacaaagacaaaaaaaaaaaaacagacgctacatcttgtgtccgtttccaactcttagaacatccaattcttcttattattctttgtcacttggtctctcttctgacgcacaacagtatatacacatacacagatat

SEQ ID NO: 5087 - DNA, 2000 bp, Arabidopsis thaliana
tgaagaaagaaagatataaatattaattttgtttgaaaatccctaccaaaaaaaaagaaatttgtttcaaaatagttgaagacagcaatgttttagctacaagcctataactgaaaaatgaatgtgcattagtgtctcactctcatcatccgtggccccgaagctgtctcttttctttggatggtaaaaagtgagaacgagaaagaggataagggcaatggaatgttgaagttgattccttgtcgtcctgggcaatagaatgtatgatctcgatagatattacgagagttgctcatttgcttccgactgtgccgatcttatatctctttttgaaagaccttagaagtggccaaattttttagctgagatggcgacatttggttcccttctttgttttttttctttcttttagtattacttttctttccagccgttttaatgtgcggaccgatagtcttgcaaaaaaggcacaagctcataatagtcttttttcatgtaagcacgtcggttcctaaatggttctctttagaagagagtttctttccgattacttaatagaaatggagttcgacgaaaaaaaaagattatatataacgtaggattctatcactttgaaatccaagtttctacgatatagaaactcaatgaaatccactttagattatatatatatatatatatatatatatatatataaatggttttagcttggttaaaatcaatttggacaagttaactaaatcaaatcaaactcattaaataggatttagtttacaattgtccatggatgtctaaattgaactaaactactcaaagaaaaatgaactttagagtagccagtgaattcttaatcaaagctcacaacaagttcaatgtttttggaagaaatatatcttatgtattaatatccaactatccattacaaaattagagaaatcgaacaatgttactacataaacaatgttgcagtcttttataactagacttgtatctaattttaagatggcaaaaggatatatctattttaaggccgcaaggccaagccttggaattatggccggctctgttattaaggccgatcaagattatattaagttaccaccttggacattttaaatgattttcccaaattacatcttgatgaacttcgtagagtcgtagttgtgcaaactatggaaaatactctaaaacatctgatcttacctggagggatgttgaaaaatgggccatttggaaatagaacaaacaaacaaataaatgagtcctagaatgagagaacaaaagagtcatgtgctagaagtagaaaccgcgttgaattaggcctcaaggagaccatctcgttccccatattcgtctgtttttctttctctatgactgtcaccagcctggttccctctttttcttcatttaaaaaaaaacatataaagaaaaaaaaaagaacatataaaggagaaattctacttcgttatatagattacttacatatttatttttaaacatataactaacaatggttgagtggagatgtgcttttagtcaagtggttaaatatatttgacttcgtttttttcattggagtttgactctactaagttgtgtttcctcgcgtagtaagaattggttatggattagaccgtatcgatctaaagatgtcaaagaaaaaaaaatgtggttgtgtaaagtaaatatgtagattgtggcggattaaagtatgttttgattcacatcattattgttattttttcatgaattctaaatgtaaagttcttataatcttatgttactttttacaaattgtaaggattactctgaaatttggtatcgaattctaagacaaatacaaaataacaatgactgaacaagttgataaaacataatggaaggaataatactgcagttctattaaatactaaagaagttggtagattggcctataaaaggagaataaagagaccacaagaaggtctattattcggggactaaagaaagccaaagaaaac

SEQ ID NO: 5088 - DNA, 2000 bp, Arabidopsis thaliana
cttattttccaaaataaactgcgggaccaacaccaactggatcatggatgtgtataaataagatccccaacaacgtttcatttcctcttcttcctctttcagtcaaaacctaaacaccaatcccaatttggtacgtgacaaattaagttatatttcagtttggtgtatatgcttcatactttcttttttcttggaataattcgtcttccacatggatccttcgtctgttgacgattatacggataagaaagatcgctgactttttcaaatccacatgatgggatccagatccatagttccgtatgttataagatgtaatcgttgattaatacatgaacatgggaagacagccgaaagttgacaaattaaaaaggagtaaaaaaatagatgagatcggaattaaaaaaaactctagctggtttagtgcgcactgcaggagtcatagatatctttaaaagttatcatatttgatatgatctaatctcacccgaaccgaaatcgatcatacaatgacaatgatacaaaaattcactagaagaaccatctctcttcttgttatatatcctctttttcttcatatacgtttcatctatttcctcattagttgcccaaattaatacttttaattttactaattggtcgtcaactatataatcccgaaaagcaaccttttcttacgactttcttaaccaattaaaaacacaaatcccagtaatatttatatagaatgaatgaatcaacactcgtaagaataagatagtaatttatatcgatattactaactgcagtctctatacactctacaaagtataactgaatcgctgtacagaaaaagttggttcgaggcttttttttttcctgacatcaaagttagttagagctagagacgctataaaattaatataaaagttggttcaaactacctttaccaggaaaaagtttttatttatataatttgcgaaacgcagaaatatgatttttctgaaatacattgtacccaaaaggacagaggagcacacgcagcacacatacacacgtacatgtattatacatacgttgtcgagattgtctaatattattatatcaattcaagaatctagttactttggactttggatgcatatttggtttccagtatttgactcggagcgcaaatctcgccgatgaaccgacacatagcattcgtatacaaacacatgtaattaatgatgtaactagttgctcatttttataaattaataatcccaaaaactagtcgataacatgtaaactgtaaaccgataagttatctatattttgcttaagattcaacttatattaatacagaaaatcgcatttttagtcagatttagaatgtgtttaacaatcaaattcttgtatggttcatatgagcaaatatagctaacagtctaaaacagaacaaatatatagaactaaacagtcggtatttatgtacgtacacatacatctataatcctataatcattgactctttttttggtttggttagcaacctataatctttgactttttgatcgcctaaaaatattagtttaaacaggtattaacgttggctacgtaatcagtaaacttacaaaatgatatcaatgatatttatttagttgtcaaaatttgacgataaaacaaattgaaagtgggttgatgaataacatgaacggacagtacggccacaccacaaacattgcggctcattttatggagatattcaacgtgctcctacttatctatgctattatcaccttcgtattaatacgtacggtgcatcgccgtattaacattaatatatttcttccaccattaatcattttatattttgaataatttctaaaaacaacgtaaaattattgatacgtaggtcggctatatatagcttgtaggaacttgtgcatatatcacaaccctcttatcttatgtatactcttttattagagacaattgatagatttgtttttcagtgtcacttggcctaaaagctcaca

SEQ ID NO: 5089 - DNA, 1989 bp, Arabidopsis thaliana
ctctttcttcgtcttcctttttgatccttagctcttgcgtcgtgctttttcaacaggcgagagaggatcgagagggttagataatttactgaaaaattatacgaatggaccaagactagagatactgaaatgagtgtttgacgatactttaaatgggccttatatttttcaagttgggcccgttaatatatgggacaatcaacagtatagctcaattggtaaattgactaacttcatttgattcctacaccatttaaagatttttaatcaaattctgatataactaagataatattttaaagcatttaactaacatggaaaattatgaaatgaaatattaattttggatagaaaatttaaaacatttatctttgtgaaataaaaagaaagtctcttataatataacttgtaaagtaatcctttaaattctaaaagatctaaaacaaaatgagttaaatcctatgtctatgtgttgaatctggaagatcgaggtggaagaaaaaggatcatgattcatgggtgagagaacaaccgttgattggtgtgtttcaactttcaagcaatcccattttaaaaaaataaatttatgtaagcaattgcaaacaaaatgaaatgattatgctttaagatatcgacacgtgtaaaacagatgacgtaccaagaaaataaatgattctgtattttgttttagccatttgttttttctttaaaggaaagtgtatgttgaaattgaaaaaacaaaccgagttatatatatagagttatttgactaaagaaggaagctttggttaaactaacttgtataattcttttgtgtagtttagttttgataaaatggccaaacaattttggtcactttaccaactactgcaaaaaaaccattttcataataataaattgtaacacgccttttatttttattattggagggtgagaactgagaccatatatgcctttgttcccttcttgtgggtccctttagcctttttttttcttttgcctgcgccgtttagtgttttttcttttatatataaatagaggtaagttattttaccaatcatttggtgttattaatagtagtattaatgaggttctaaacttgtttataaaaatcagatcttactaaacaaactcaaagaatctcaactatgaacatttttcttctagaatcgagttttaacatcatcatcagcaggatataattttttgtgtttgaattttatctgtattttttttaggagtacataagcagcttaagattaaaatatatattaatggaagtatgaatgaaaaaagaaaagaaagataatcagataatagagagagagagagagagaaggaagcagacatttgtcttccaccatattcttctcatcttttccgatgatagattcttcttcttcttcttcttctactactacttctgctcctctttcttaagtttctccatttgataattcactcaagtctccagctcctcttcttcttctcgttgctttattcgctctctttcactcatcatcatcacactcaaagatttctgttgtattggagcaagctctagcgaattttcgtactccccttgtagaattttagtttcctgttttagatttcgaggaatctcgctttggaaactttaagctcctgttcaaagtttctacctttgtttattttgtttttgttttcttctctcttatctttcgtcatctttgattaagtaaccactttgatctctcaatttcagcctttgggttgtctaatctgacacgttcctctgtcttagctttccttttctcttctcgtttgtgggaagcctacaaggattaattattaaatacccaaccccaaaaaattcttcctttttgattctctgattcgtccctttttgtacatggtttctgtttggttgttagagcttcttgctgagttgaattgagctggttgcaatcactctgtttcttgggggttgatcgtgtattcaagtggtgg

SEQ ID NO: 5090 - DNA, 1583 bp, Arabidopsis thaliana
ctttctcgctttttccttcaacttcctagtatctctccacacactctctactctctcactcactctcgctggttatgagagtttgagagatactgaaatttcaaaatttggggtttaattgcaaaagaaagtactaatttttgttgttttgttttcctgataatatttacaaaaaaagatgtgtatttaagtgtagtgtcagcaaaagcagagagagtcgtctgcttacatcatctatttcaccaaaaaggtttagaccttcaaatttgtttttcttgtgtctggctcttctcgctctgttttgatttttgtaatttatatactttcttttagatcaaatcttttgtctactaatatatccttcctatataaatttgatggacacataattttagttaggatctctatcaatccaaaatcactagtataaagctgaatcttattttgtttttgtttccaacgattcaatcttttttctataaaggtttaattaaatcatatgtttgtatgtatgtacataaaattgtgaattcaaatatgattaacaaaatgaaattcgactttaattaacttaaatactaatctatctttttgtttttgttttctgtcgaataaattattatctttcacacacaatgtttgaacataatgtttctttattattcgtatctaataaatggtataaatcgtttttctcgatatttctttataatctcattttggaatattttattcgttctaagttttataatttacatcatatgtagtagtgactgtagtatcttgaaatatttattttttatttgtaagttcacaccaacttttttgaaagaaaaaaaacccgtatacaccattcgcatatgtataattcacaacgagaattgtagaatagccacacccaactagctccatcgataaagacgcgactaattaaaacatagcctcactcagaatcgcagatgcagaatataacccatgcatataatatacatttatattcataactcggcaagtcatttgcttcattatactagctaattattgacaccaacttaggcaatctatgaaacaatccctaattgtagatttttgggcaatttagcgaaggagggtcgaaggaatctctctcacgttccatgcatctttttatgtgaccagttgttttggttaaaaagtaacgagttatggaactacgtacaccgcaaatccaaaaatgtgtttagccaaataacatcaacatttttttttcaaacgtataatatttcagcttttttttttgttaaaacagctaccttaaatattatgtaacactaccgacaaaaaaaaatattatgtaatacttgagaatctgacaagataaagaaagaaaagataatgcaaaatcaagaaactattgtcgtgttcgtgtagatttgcttttgcatgagcgcaacccacgtagatattcgtagcttgtgacacgtatctacgtattacacgtggtgataacccagtagtcgttaaattagatcggagagcatataaaccattaagccaaataagtttatagtttgataagaaaagtaagaagaagaagaaagaag

SEQ ID NO: 5091 - DNA, 2000 bp, Arabidopsis thaliana
tcagggtttaaggagaagaggaagatgaaaattgcacgatttcacttttcacttcaatttcgttcttcaatttcataaaactggaaaattagggtttatggacacgtgtgaatactagaaaaaaaaacatccatttttctaatagcggcatggcttaagtccgaaccgaagcggctgaaccgtccaaccggagtttggttgatttctgacttttaaaattttcgttaccaccaaaccgaaattctaatcttaagtccgaaccaaatcgacatttttttattttttaattaaccacatattagttaaaagataattatatgattggtcgccgaatatggaaaaaaaatctacaaaacaaatttgagaaaacagtaaacgaaaagaacgaactaaacaatctgtcttataattaaacaaatgagatatatagaaaatcatgaaacgagaaatataacattcgacattttgtttgattttctactatataacttttccaaatataagtagaaatgtcgatttctaaacaaacccgatctgaataatcatattctccaaatttagttatggcagttcaaacccataatggtgaaggttctcactccagtattttttttattatagcataccaagataaccagaagaatgagccaagaaactaaacaaaactaaaaccaaaactagttccaatcaactcaaacacgaaagtagataaataacaaaccacatgtgatttcaaatttagtttagtctaataaaaaacaaaaagactaaaccggacgaccatacattgggtccctatcgtaaattagcaaacaaattagtgttgcccattttaaaagtttgaactcttctttatttaaaaaaagaagaagaagaattgaactggtcaggaagaaaaaaatagaaaaggagaaaaaggacagagggaaaatggagaaaagtagagtaaaatggcgtcacaccagagagaaggcacaactcacggggaaatcagcagaaccaataccaccgccaccggttactattactattcttgttatcatcatctcccaaaaaaaaaatgttagtattattttcgagtctatttttcaagtttttgttttgtttttaatatctcgactttgccacccaactcctcccactccttcacaactgtgtcctgtcctctgctgatttctcacctttccatcattcatttcattctttcttttttcccatccgtttcttttattcttctttctccttaaatttaaaatctttgaattaaattattggattttattgtttcaaagcgtttctatcatcaaaacccatcttcttcttcttaagattctgaatcattcattgattgatttagcttctcttcgacttcttaattttacagttttttttgttttttaaactttaattgatgcaaataagcaaacttggatcgctgtgagcctgtgataatgatttcttttaggtttgtaggatctgaaggaagctacggtttatttttttttatgggcaatctctaacaggtacaaatcttctcttagcttctctcttacaagatctttaggttatgtcttgttctttggagttgctatctttcttccatgttccagaggtttgccttattttatcacttttgacataataatttattttgcctgttttttgttacttggtttaatattcagatgaatctttgaccatgatctctaaatttggttcctaggcaagatcaaagaaagttcatcacataggagttgatcatgaaccatagtttcctcaaagatctcaactttgtctctagttggattgtaatctgtattgcttaggacagttaaatcttattacatcttggctcgtcatgtcaaaagctgaagatatttgagctttcatatcttacaactaattagtttcgtatgtctacaggtttcttactgtaatttttctgtttcagttctttacgggtatatatatacacataaaacggttaagctctagagaag

SEQ ID NO: 5092 - DNA, 2000 bp, Arabidopsis thaliana
cgtactatatattaataaatggctcgtttttgttcgagaaagtggaacaaatggttgccttttaaaaatcctttgaccctaatgtcggaagttcgaagtatacacttgaaccatcccatctttaatttcccactctttttagttgggccatagcccatttcataggtttcatcgaaatttatttttctatttgtcaatgttgtcaagttgtcacaaagaaaaaaactttgtaacggacaacaacttagacaaaaatttttttaagtattttagacaaatctaaacctaccgctatgaagtgcgtaatgcgaatggttgagtatgtttctagcttatttaattgagagagaggacacgtttatagtttctattagctagatggattaataggaagggcttgagaggggtctctgttttggactttaatagcccaaaaacagaatacaagtcaagccatatgggtccactaaaactgcatgagagctacgtgtacacaactgttacacaataatattataccatttcacgtctcaattaactttctattataaacaattactttatatagtaatcaaacgtctttaagtttttaaacggtccatttttcacatttattacaaacaccaaaaaaaaaagtgaaaaaaatctaacgtaggagaagaaaattggtaaagcaccatcaagcaacgtcatgaataaataaataaaaactctttacaataaattatgtctgcctgtttcaatttaccaaacttcttttgattaaaatctttggaaccaaattaaattttaattacacgaaaatgtgtttgtaagaaaagatagtatcattcatcacatgtaatctctacgcctcttaatcctctcttccctcatccactgcttctttttttaataacccatttcatctctttccccttttacgctcttttctttcttcattttctgtggaaattttcagagcttttctgtgtaaattaaagagttcttttttgaaggaaataggcaatctcatcctgagaatcaaacaaccggaaaattcaataaatgaaacgcctttaattgttttttcttacaaaacttctaagcagattactttggcggagacccatctgattggtatttttgcaggtacacagtttcttcaattctctgtctttgttttgtttactttctctaccgctcgacgatcggtcttgaatctatttcatttactggatcgtttttttttatgtggaaatggtttttgttttaatgtgttgattcaattgcaatagctgtgaatctaaaggatcgggattctctaaccttagggtttctttctttatgattggagcctctttagtgcttaactgttttttgtttgtgatgaatcggaatgtataaagatgcaatcttgtaattcgctttagttatctgtagctacattctctcttttctctatttccgacaagattttgagataatgttgcaaggactttgatttttctttccgtatatttcagtgagtcccctaatgaagtttactgagttaagcagaagtgttggtttcttagttaactgctaaagtcatggttttgcaaatgtttctgttgtttgcttactaatggagttcttccagatgaagtttttagtgtgttttagcagtttctcttatatgaaattgatacttgtgaaatatgatggatgttttgaaactaatggtttactcgctgacgtttcagatattccgttcttggagtaccaactggcctggagctacattccttagcctggagtaaataataggctgaccctttgaaatcaacatggtaaaccgggaatatgtttctcagtcctgtgttatatctttccaaactctcatcaatggattgtttgttcaatttttgtgtctccttctttttgtctggctttaggtttcctcaagaacttaataacttttcgctggtttctgtcctggagcgttgttgtgtgtttggtcagaggtattaataagtcca

SEQ ID NO: 5093 - DNA, 354 bp, Arabidopsis thaliana
tcatcaatgaggattcttaaaattttgatattttcttgatttgtagaatgcttcgtttacgtaagcaacagttttgttcgaatttcgactcatacttatatagtaaactgtagcaaaagttcggtttatcagaatcttaaaccattacgtatgggaaagtccggtttatcaccaaaccagtttatggaaacgaatttgtatgatgttctaaataacgattttaacctcaaagcttctgttaaattacgattgtgccataactatataaaggagagacccgaacaaacaatccggaagcggaagctaaagttaagcaacggccgccgcgaagctaacctccaaagaaggggaaaa

SEQ ID NO: 5094 - DNA, 2000 bp, Arabidopsis thaliana
catttaatctttagcaaaaaaacacatttaagtaatttaaccaaaacatgatctaatatgaaaccgacggaacatagactagacaaaccatagttaactcttaatctgtctaaagactttttttttttttttggtaaggcttaatctgtctaaagataaagcatacaaaactggtcattgtttcctttagaatccaagacagcttgattgatattaaagatctacacaaactttattgcctctctgtttcatttcatcttttcttttcttttctcccgagagaaagggagaagccaccaccttagaatcttaaacgcttttctctaattctcttttgcctttccaagtttagttttcatttaaatctcacagttttaggtattattgatgtatatacattccctggatccgggcatatgtatggatcacttttgtgaatgattctcctttcacaatgtgatgctttgctttggtttcaaataagatgaagctttttccgcttggatatctttttctcgtatggaaaaagagcggttactttgaaaaatattcatatatgacttgtaccaaaacgagttgtttatgataatattaatacatgtagttgatcttaaaaaagcttttctatatatatgtatatgcatgcagcaaagtttttctatatacttagctcactacatctataatcgattcttaagaacaaatatttgttggtcaatttctaaatgacaacaatttatgattatatgaatcataccacttgaaagaaaacacccatgtgtaaacacaacgatatccacattaatatatttgcaaaataagatgaatgcatataatatgaatgcgtatagatgtccatcaattcatgcatggaatctaaagtttatcctcaaaagcaggaaggaagataaagttaagcatgattttagaaaagtaaataattaatttatttacaagaattgcagaaagtgggtgacccttttaaagcagaagagaaaaagagagggtaaaaaagctaaattctatctctctgcttttgggggggttttaagcttttaagagtcttgtgatgggcatttagtcattatagacctaaactttgatctcaacataatgcactttttatctttaaaaaagcgataaaaacacactaactttttctcctcttgtaaactttttaggttattaatttttttttttaaaacaagatagtactagttatttattagaaactaatgtaagcaacacatgaatccactataggttcaaatttaaatatactgagagcttactggcccaaatctatatctcaagaaggggtcatttcaagggcttaaatatcttatttcttctatgagctcactttcaagaatcttcaagatgaattagtatacttcaaaggcgtgttatgactgacgagtatatatatgcatgtctattttacaattcctagaaatttatttcaaaaacagtttgtaattagtacctcatatatgattaaaatctagatgatggagatgcatcaggcaaaaaaactagaatcctaatcataaaccctgaacagtggcgtgttagactaaaatgggccgttaaaatgttaataattatttgggcttttttgataatcgataaactcaaatctctgattgttataaaagtcaccaatttcgcattcgcatatagcacattcaacgtagatgctcgttttttttggtcagctaaaactaaagaaattttagacactccatgactccaaatagtaagtcgtgtcgtgtaccttcgctttcaatcccgatttgactattaatgatctttctaaccggaacctactcagcaactcttttccgattatgacacttcaactacccaataattagtaataatttacgagactaccccacttcagtttctgttcttatcttaaaacatcatatccataattacgacaaacgaaacgacgcagtattaaggttactctctctcaaactctcgtctcctaa

SEQ ID NO: 5095 - DNA, 2000 bp, Arabidopsis thaliana
gtaaaaccaaacaaaacttgaaataagaacaacgtgtatgcacggtagacaatagtgttattgtcccgacgtgagtcgcattatagtgtgtggattaccaattccaaagacggttctaacattatggatggacaagcatatcagttttaacttttaaaagttcggatgtctctaacaaataagggcctgactggtttaaacgcagcggatgcggttgcggttgcgggagtttgcggaaacaggcggttgcggtttcaagcgttatcaagtgttttgaacgactggttgagcgtttgataatgagtgcgtttgcgggagttttatgattggtaaaccagcgggtgcgatagtaattaaataaaaaataaccaaaataaatataatatattactagtaaaagaaaaaaatacaatatattattatgataaattgataatattagaaaaattaaacatgcttaataattaaaaccataaataaaacattaaattcaaaaataaataaattttgtaagaaaaagcttagtactttatgcatttggtacatcaccaaaaattgcatcaagtagtgtaataaactgtaaataacgttgaactcgtgggttttccggattgcctctatacatatgataaagttctaacaagaaacgggtcatctcgtctgaccaaataattttctaatcgagaaaacaaatcaaaacatgtattcaatcaaaaaactcaaaaaaatacaaaataaataaaatgacgatgccataaaatactcagagaattacactagctaatgaatggatgaaaggatagatcatacttacgtttgattcttgattttgattttgattttcgttagtttgggtagatgccataattgagagaatagggtttcaatatattgattaggattttctgataagaataagatatatagggtttgggtggaagacataattattttagttaattaaaaaaaaaaattaacctaaccgctaccgcccgcaaccgcaaacgcttgcgggaaggaacttttaaaatatggcgatttcgagcggtccaaagcggtatctaacggtttttatgattggtgtcaaacgctaacaactgctaccacccgcaaacgcagcgtttgcgggtgacagagggagaaccaatcaagctctaagactaatcggaccaatttagcaacttgtgtgcttcgatgtgttggactgggctagattgggcccaaatagcctgttttaacattcccaaagatccaaacaattccttcttctttcttccgaacaattcaatgtagatccgagcgaatctcctaaattactaaaatgcacaattgtgctcagcttaccaaaaaggcccaaaagaccaaaacatattctgattttttctctttagatacaataaaagtaatttatatagattagaggcccaataaggttcacgtaggcccaaacatattaaaagtaactcagaagagatccatcaaaattttgattcacacatctgtttaggaattaaaaatattatttgatcggttattcattccttttcatgaaatcatgcaaaaaatcaaaaatcatttttttctctagaaactacgtggcgagaaagcagagcaccagttgtcttcttgctctgattatctcgttgaaaccgctttcaaagcagagcaaaagagacgacaccggagcctccactgctttacttttcctttaaactgtgactgctttcatttatataataaaatacatacactctcagagtcacatgtactctcctctaacataaacacgtcacttgtagcgaaaacagtatcaagaaaaagagaagatcaaacacgtcttcttttctctctctctctttgtcgcctaaaattccagaatcactctgctttttacccttttaatcaatgatttttccttttagtagcaatcgttggtgattcgaaaaaccaaacttttctcggactaggattctagggttttagtgatcatctgaatattc

SEQ ID NO: 5096 - DNA, 2000 bp, Arabidopsis thaliana
aatgatgtggaaaattcaagagttttcattcgaagacctaaattttttctcacaatcttatctcgtgagggttgtcgctgaaaatggaatgtctcctttgttattatccatttacgaaaaaataaaattctcccacatctaataaagttattttactaattactatttgaaacaccttttacactttatagcttacttgtgtagaattttattgaaacgaacggaaatgtagtcaactttgatgccctgatacttgggtaatctatatgtaacaagtacaagtatacgagcttgttagttgttaagtgtgaaagagcttgataacaaaatgtcattcttctttgtgtgaattgattttcctgtatgcgaatttttatataataaagaccataaacatggtgtgggtcttcttcactatccagttcgattctttccttctttctgtttcaaatatttgaccccaagtcccaacaaatattttaaatatgtatcacaaaagacgcaaaatagcttgcgatttttccgtcaatattaaacaattatctagacttccacatggtgatacctgtatattaatacaacacgccaattttaaaatcgttatattgttctcgttatggtgagatttatagttaagcttaaaaaattaggatatgaattggatacgatcgagagttgccaactattttctttaaaaatcatttatcatcggattaattaacacatggtggtctgaaattcaataattccgatataatttttctgttgataaaacaaaataaaaaaattgtaataggtcttaaacttgtcgcatattatgtcatttcaattgtatagcttcgatatcaaccatgtgtttagaacatgcacatgactaaataaagtattcttggttataaaaaaagaaaagaaaggagaagcggattggtgaagaaagtatatcatacaaggtcaatgatactggtttggagcttacaacgctgtaacgggtaaggtctgtttttgttatgtcaaaagataagacagtcgtataaaaaagtaaagcaggatactactacaaaagggacaaaggtagagtccaaattttgacttttccactataatattcaaatatatattcaattgctctttttcatttcgcaatgcattgtttaatctccacgcctcgtgtatgtccggatggtggagagtccagacacgttctttattaactctggttgaaatcttgacgtgtaaaaatatcaaattcgtagttttattagttttatagtatatagtattatcaaaaaaacaagttatactcgagatttagactcgcataagcatatattgaacctgacttttttgccaatgaaagcataaaatacttgacttaatgggataaaaacacattcagactcgagcaagtaaaacatattcttacaaataacttacaagttacatgtataacaacactcttatctttatcatgtaaacaaaaaaaaacgctattaattgtaaatatttcatctgtactttgtaaatttgacatgacaaaaaatttagatacttctaaaaatgtacaactttttagccgttagaaagaaaaggtgtacaacttttcaatacgaattcttatattaacttttgttccttcagttttatacatatagtcatatgacattgaaaaaccagcacaaactccttcagttgatcaccaatagaaacaacaaaatacagtataatatttctaatttttagtgaaaatttacgaatattgtggaaacaacttttatagatgtctgagtctgacttatgtcagtattattttttcttcacttatagcagtataacattcattatttcacattaatgccaaaaaaaaattaaaaactttattatcaaatataatattcaaatctcgatattgacaggtttgccctcgtcctttgcctataaatttgacatgatctacgttcattcaaacaaaaaccaagccacaaagaaattaaatacacaca

SEQ ID NO: 5097 - DNA, 2000 bp, Arabidopsis thaliana
gaaataagggtcaagtcatctttttttttaattaatttaggttaaaaattaagaaaataaaatgacaaataattaaacgattgtgtcaagtaaaggaaaataaagatcttggaatttaatttaatttagaacaaaacagatttctgatagtaaaccgtaaatttagtggtggctatattatgcagcaagattatcagttaactagattttaatctgcggtataccgcggggttatatcttttttaaaaactaaaaagttaatttgtttagtagattaaataaatataattcattttaatattttctaaatgtacaactcttatatatatatatatatattatttagtatacaattactatgtttattttttactgtttaacaatatagaaagaataacacacagtttattaagttaaaatttagattataactaaataattcaaattttaattatattaattttattaatataatgatattttgatatatatatatatatatatatatatatatatgatttcacccatgatatactgtctcgtattattatcgatccaaagccgtcatatcatctaatctcgttcagtgaaattaaacatatctaatagatttcacccatgctatactgtctcgtattacctatcgacccaaactcgtcataccatctaaccccgttcagcgaaactaaaaattattttgttatttttgttttaataatactttaatttaaaagatatataattcaaatcagtttaaaagttttattttaaatggttatttaattgttttaaaattcatatattataaatattataaacccgtcttatcatctaatctcgttcggtaaaattaaacattatttttttattttttgtttgaataatatttttattaaaaaatttataattcacatcaatttaaaagttttatttcaaatgattatttaatttttatacatttcacatattataaatattataaaacgtttttccgttaaatattttaaatgtttaactaactataatatttatttttaataaagtataatattaataaattcctaagatttctcctttttaaaagtaattagaattgatggaaatatattagataaagaaatgctaataattaagaatattaattagttataataattaaatatcaatgacatccactgtaaataagtcccaacttaaggatttatttactaaaatagctccaaaaatgtatatatagatgttatcaaaattcgaattaaaaagttgtaaaaagactcggaggcggtcaaaatcaatttttttattttcttgcataaatttgtgaactccagagaattaagaatgaccagtgatagagctccacgtggatagattgggttccaaagtgggacggcgttaaatataaaaaggccggaagttgtcgaagtagtcttttttcccattatttctgttttcggttccttattttgttcctttgtaataatgagtgacatcaaaaatatttggggacgaattaacaggtaatgtaaatagaaagaaatagaaaattttctttgattttacaatttggattcggattgcataagcaatgacatcaacagtaatacatagctgagaggctgagatgcagtgtctctctctcagggaagatgacaaaaagaatctgatatacacgtacgtatgttgcgagttacatattgatatatcacatgtcataagtcacatgctaacgataaactaataaactaaaacaattatgtcaacatatatcggtgaattgcattatcatcgacctcggtcactgttccgcacatcttggtcgccacggaacatagacaatttttggattgtagtccaattaatgagtcccccaccaaagccgtagtaaaatcgaagtcgttctctaatccaatcatatatatatccataacacacaccaacaacacccacacaacaaaaactagagtcagtaacaacacaagattaaaaagaaggagaaa

SEQ ID NO: 5098 - DNA, 454 bp, Arabidopsis thaliana
gatccatccatgataacgtccacactcgtgcatcctcctttaggattttgtgcgaggatttactgtttactggtctctcgttgtcagatgtaaataattaggtgtcgtcgtcagtttttagattttatgcaaaactttacacttgttggtgttctttacttttgaaacagtacactcttcttaattttaccattttactcgttttgtgtttgttgttttcttatttatgaaacatgttttgagacggacatatctaatgttatcgggtttgagtctttactctgtctcctcttttctcattcgtgatcgtgttcatagatgttttagaatcagtaataatttgacatgagttatgacttatgaatgattgtcgaataacgtggttgctattacatataccaatgattctgtaggatttaaacatttttttgtgttctgtcgtaaaccatgtaaa

SEQ ID NO: 5099 - DNA, 2000 bp, Arabidopsis thaliana
aaaccattggtcaaccattggaacaagggagcttccacaaaaaatatattcatatatatatatatatatatataaacagttgttacaatcccaatcatcataaaatctgtagagtcctcttccaatcttaacatcgtagacaacgtttggatttctgcaagtggagtgggtacttattactctccaggtattcctgtcctgcatgaagttgttgtcaactgtatagagtccgtcttccttaataagtatagtgaaagagcttgtttcaaggaacagtaaatggttgttgtcataaagcgttgtccactcagcagcattaagccaactttgggttgatgctttaagtacatgtgcgacatctggcaaatatagcatcaaaatatattagatttgtagatatataaataactatcttagttttgctacaatgtcttcttcaattagaattttccaagcatcagttctatcacaaaccttctcctagatctccctagaatccagatctgctacattcttagatttttaaatcttgcctaagtgttacaaattccatagatcttgcattccctaaatcttgatgttctaaaatttctaaatacaatgcctcgatttcccaaattcgccacagtatctcgatgatctccttcaaaactaaaagagtttttaactaaccaaatactcaaatactcctaatttgtattcttaaccctttaaccatagcctaaacaatacccaatttttaaaataataaataaacacttacattgtttttattgctttctttgtaaactatgaatttttttttgtatatatatataattttatatagatttcactatacatatgaagaaaattaatcagacacatattattagttgcactctcattttcttggaagtaggaaaaatgatataacttgtttaattgtacaaacattacccaattttttttattttatttttgtcgtattgttttggccgaaccattttcttcttttataaaatgggaatttttgcattctattttcgtagacaaagagtaaattaatcatttgtgagagataataataaactttggatgttcttgtctagtagcttaaaataaaattgagtatttttggtttagataaatgtataaatggtgtctaatgtattcttaccattggatgtttgacaaattacacatttctccattttctttagagtaatcaaagggataagcattgtaagagtttataacgatggtccttgtgatgatctaaataatgcattaggcagtgcttgttgattaaagaatgatgaaatcctttaacactcacatgttaaaatatttgttaacatcttgtccttaatattgttaaagaaacttaactaaacttgttaacattttgattatgggtgtcaaaatgggtcaaaatttatgggtcaactcaattcaactcaacccatgaactctaatgagttcaaaattttgactcaaatgagttgatgggtcaaatgagttgatgagtcaattggtttgatgagtaaaattagttgggttgtaatggttaatggtactatgagatcatttcaaattttttgatacatggtgttttcctcccaaatatatgactataatatcactaaatactatgagatctcgtagagttgttgagtacgataaaagaatctatgaaaaaagaacttaaataaagaggtatacgtttgacaaaaaaaaaaagaaaaaagaaaaaggaaaaggtataaaaaaaaacatttgagttgggcttatatgggcctgtttgaaatttggtgacattacttttcgccaaaagaattaaaaaggcccatataggcccaactttaaacattactctaatatttatatctttctcacttttgctttattctgatttcttctcctatctccttctccggcgaagaaattgaaaattcattatccctaaaaccctaataaaggtccagagagtcgtcagaaaccaccgattagcttttgaa

SEQ ID NO: 5100 - DNA, 974 bp, Arabidopsis thaliana
ttctaaaacgaaaacaatttacaattacgagtgcagaatacaaacgagttgatatagattgagatttcagattacataaatatcttatacagaaagtgttaaaagataattcgattggattgatgttatatctctatcattgtttttcacttggcctcggagattagaagcagcttgttaatgggcttttaacagttacgggctttaacgggcccaataacaaaactcttttgcttcttatatgattttggagtagatggtaagtgagatagggaagtggtgagtgaaattagaaaattcctcgtatacaaagtcctaaccaccagtcaaattcaattgaatgctcccatgtttctcccttatctgttcctgaacctacactctttaatttcatggtttcctattttctcttaatttgtttattttcatgtcatattcggaagcttcagatattttatcaaataatgcatccaaataattttgagccactagtcaaatatcttcttcgtcttcttcttgcttaatatatattttagtgaatctattattgataccacacacacatctttgatatttcacaaaaggtatctatcggagccgtacatatattttacgaaaatgtggataagagcgagatttggattggtattggtaaggcaaattaaatgcgacacacttccacattcatgattccacaaattctaatggatttgaacaaatatgggaccaatttttatttgtttcaactcctaaatgtgggaccaattaacaaggttgatgtattcttcttgttcttcctcgttcattaatagtttgattgagcatgcacgcttctctcaacccaccagtccaagtcaaacctcctcaagccatcccctaatcctatatatcagtttcttctcgcaaaccacctcacaatctatcaacagttttaaaaaaagacataactcaaccaatctcactttgaaaaagac

SEQ ID NO: 5101 - DNA, 2000 bp, Arabidopsis thaliana
actccaaataccttttttctttactaatcccaccttgcttttatgctctttcttttgtcaattaaatatatatatatatatatattatattttattttattttctcaaaatgactgttagatgttttctctgtataattgtattgtttgattcagaaacacttaaaagtatatattatttgtataattttaatttttgttattaactacaaagtaaaacagttggtaaaaaggttagtgagtaattcaaactgtgaaaaagaaagtcgatttacttgtagaattacaaagtaattgaacttttttttaatgtttcttatctattgtcaatatatctataaaaatactactgccagactaaaataatacattttgtagtaaatgggcaagatcgttacagagacagacagacagctatctcatcaaagctttgtctcctttcccattacccaattttaaaaatattttgcagcgtgtgaatatcctttgtacaccacatactcttttcacatatataatattaaattacactaaaatttgtgtacaactattacctatatgtatatatatgtcagcatgcagcagctaacgaagcaaaaaacatgtattaatccgactgtctatatatgtaagtaacttgcgtttagaaaaagaaaaatatgtattagggacttgcattgcgtttcttaatcagaatgtaataagttaataacaatgctgaaacacattgacactaattttaaaaaatcttttcggttagagcaaatcaatttgcatggccaactactggaccgactactattgcaacttttttttgttttgtatagtatttcgttgcgtgtatctgcaatatatatcacccatgacccatgtctatatttattgtatttaaacgaaggttggtccagtgtattaatactgattgattatgacattttaattgaaaatatcccaaatatcaactctactgtagtccgtagagagacctgaatctctaatttactgttttttaaccatgccatcaaccaatccaataagaaaaacaggaacaaaatacaagtgaaaacgaagtagcaattgcataatttgggactccagaagtttttttattaatcctatagaatcaaatttttttcggaatcaaattttaactttaactattgtatcattacgctaactatgagaacatcttatattattatatgatttttcaactgttaaatttaaaagttgatcattttgttagtatatgtttcaaaaaatttaattttcaaaattatgtcgtagtatatgaaaaagcaacgagtgttttatatgataaagtagaaactaatgattttgaactaatttaatgaatctttaaaatctatgccggctcctaagtagccgagctgaaaacccatggcattgtcatgattcacgtcctggaccaaagtctcatgagtaaaccggtgtctaactctaaccattgtaagctattttgcatttaattacaaagtttaaaaaatcccccgaaattcctgaaataactcaagatatctccaacacttcctctagggttatcctgtcgtcttatttaaaacccggagttggggtgagaagccatctctctccctctctatctctctccctctctatctctctcttaccaatttccatttctcgggggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaag

SEQ ID NO: 5102 - DNA, 2000 bp, Arabidopsis thaliana
ttaactttcacaacaattatagccttttctctacgcattgtttggaattgtggtgttctctacgcattgttttaaacttctgttgtttaagaaattatagaatatctgcataaagtatgttaaggtttatacgtttattcacatgaacatgaccatgcttctgctatcgaagaagaattgcaattctcatggaaaagcctctgttttttatagtgcttagtaagtatagagactagtaactagaatattattagattggtttatgcatttcttttatggcttttgatgaacaattggtccatatgccattattttcggttatatggtccttatgtgacacattactgttaagtgtttctttctcatctaaacgttgaagagtagtttgattgttgtattgaccgttaagcatttgtactcttactgaaatcttgagagctgtcattttcaggtgtatgtagaattgcagactacattctttaagttcttgagcttggaacaatacttttctcactctacttgtttctgcaattaaatggtaataacaatttctaatgtcagttaaaaatctttcaagttgatttttgtttagctttttctattgaggttcaaacttgtaagcacgcgattgaaaccaactgtagaatgacagatcttgtttgttattctgtctttatgttactttgtgtcatcttctatatacttttacataccttacagggccgcttagtgatcttgaaatggctttaaagaacaaacttatcactgacatgttgtcaaatgcttgaatggtgccttttatgtcttgaaagttagtctttttgtgtcggttaatgcttcttcacttgtttttgttctgttcggttatgaatcttattatcttaagttgtttgtgttctgttctaaattggtttcattgtgctctgttctaattggtttgtgttcgtgttcaaacttcaatagattggtttgtgttctgttctaaatgaatttcaacttcgttttaaggatgatgtccctgtcgagatgcaagagttcaaggaagcataaatagcaagcacatgcaagtgttgttctgttctgtgtataagtgtataggctatggtcgtgtgaagatgcacttgagtttgtgtgtcgaattttgtgagtgtatcaagttttgagagcgtagagtctgtgtcaagttttgagagtcaaatgtatcccaaacactttcacatttttttcaaaatttttttttagttttattagaaactcacttaaggatttttttaatggaccaaaaatttttcaaaaactctacaaaatctctaaactacaaaaatatcaaaattaattaataaaaaatacatagaaaccttacttagaaactaaccaatgtggttgctctgagagtactacaaaaataaaataaaatgtgtaatatacaaattgcaagagaatacataacataacagagaaattcatatgtacagtaattgaaaatcgtcgagtaaaccaattttggtttggataccaattcagtttttggttagattcgggtaattaaattaaaccactcaatgaaggacacgtaagttcttcacgaaccacatctgttcccttaaaaaaaaatctccaagtcccttgcactattctcctctctttctctccatcctccatatttgcagagctcgagattctccttccctatacaactctcatctgtaatcgatacaggtttgtcttctacctcttctctttggttagattcttttataatctccgtcgctgcataactctgactgggttttcttcggcaaattctgatttcgtcgctttgtgttagttttagttccttgatttctaattcactgaattaagaactcgaagtatgtttactgttcctttgatctgagggttaggttcttgtacttgtaagaaacttgcttgttctgtctcatcgttcatgggatttgatatatcatctaattaatttttcttctttgatgaattttcag

SEQ ID NO: 5103 - DNA, 533 bp, Arabidopsis thaliana
tagcttttacttctttttttttctctattggcctaaaaaagtctcaaaacttttccttgtataatataagcctttctgcaatttataaaattagggttttgcttaaaatttgttctttacattgtttacaagccatccatttcggtatcattaacaaataaaaacaagcgatctattttgtgtttacagctgtagagtcatagagagttgtgtaatttgtgaagataacttttcatcgaccactgtaatttgtgatatctagtccaaactttaagaaggcaggcccatatttggcccaattaggttattaaaataacaacataactaaaacccttgatagctagaactcgctctcttttctcagccaacaaacactagtctcttctgatttgtaccctaacgtttactcgacttatctaaagccgtgaacctcgccggaattcttaaagtcgcgatttttccttaacgccgtttgattcccttacggcctttgaggtccaggagatagcaaatttgttggtgagtactgaaaa

SEQ ID NO: 5104 - DNA, 2000 bp, Arabidopsis thaliana
gagtataagtaaaaaatgttttggtctggaattgttcttttctttattatatatatttgggtaaagaattgtcaatgtgcaagatatttcatacattaatataaaatggggttagagcactaggtcaaaaatgattttcttgaagtgactctatgcttgtattagctttcatttatttttactacaccctagctatcggaattgtacacaaatatcttctttttttataaagaggtatacaaaatgataacaagtcaatattgatagaatcattaggatctaaattaaaatatatgagtaagaagctatgacgcattcgatgacatttgtcttcaacaaatgatggtgaaaacaaaaatattccatctcgaagaccctttctatgaatattgtttcgctttattctctttaatatttaaagaaagcattattgattatgatgaaatattgtacttagattaggcatttatcctagttgatgcaatgattcactaaatttgttgcattttttggccgagtttatattctattcactcgtataggagaatgccacgtcgaatctaatacaaagtcatattcttggcgttaacgcaaccatttcctctttacttatttaattacttttatatcttgcccccaaagtatagggttaacttatttccctttctttttaataaatttttcttcgacaaaaatgagataccattatcatatggggataatatatatacgtttcttactcgtttaaaaaggttcataaccatgttgacaacgagttattactttgtctaggtttaaaatggtagtgttatatgacgaataaaaagggtattgtccatgtatgaaaaagctaacgaaccctcgcccaattttaatttgttccttttccactttcttcagaacaaaaatgaaaaatttattgcgtctaacctcgagcggtataattgttgcgtgcatgagatatcagcagcaactgcaaaaagcaaacccgttagttggagaacatttacttttgtacctttgtaaatgtattgtatttatacaacaatatatatatttatataattatttattttcgttatatacatgacatcatttggtattttaattccgtatttatacacagatagaagtcactatttgttttgttaaattcatttagtaacttaattcatcataagtgaatttttattactagtaatctaataattaatcacttttcatcttgtaaaacgagtcaatctccatccacgattaatattgtcacgttctaaacataatgtttaacttttatttgagagagagagagatagttatttaaaagccatccaaagcaggccatctttttgatctaatcttggactcatatatattacatgtgcattcattaaaagttaaaacatataggtattaaaataacaattaaataaagccgaaagttttagaccctcaattaagcaaacattaaacgaatacaaaaaacctaaactgcttcaataaataaaacaattacaaaaaaaatatttaaattagtacgagtcttgtgacttacggcatacttattgttttgtatatatattcgttcatatatactgtatttttttagtcatcggatattatttaggactcatatgagccaattttgaggaaaattgtttataaaaatgcacgaatttttcgtgccaaatagtccactttaacatttgcattacgagagattaaagataaataaaaaatgagaattcttctttgtcgctctgaaactcctccaaataaattgaaaatgctggccattcggttgggaagacaccttcttcaccaggtctgaacagtccgtaaaaatagctacttgtcggcaccaatcataaaaaatattagttatcatgatttttatgaccatgatttttaaaaatataatagataaaaaataattatattagttatcaaaagggaaaaacaaaaactaatatcaataatgacaatgtgtattttaggaaata

SEQ ID NO: 5105 - DNA, 392 bp, Arabidopsis thaliana
aatccaaagtgcaagttgagatagttgcggttgatttttagccaaaattcttgatagaatgatctccaactttgtctctaccgatgcaccaacgcttgttagaatatgatggggaatgcccgatgcgcgccaaacctgttgagcataaaaacaatcaaaaaataaatgctgtgacgtttcctcatcctgacagcatctgcgacatatagaatggttgttgatgtgtctgcgacgaagattatctcccgttgctaaagcctcagaacaaatcttccataagaaatgtttccccaggtttatagataaaagaatggtttacttcactgttgaaacgttcaaaacaaaatagcaaaaaaaaaagacataacgggcccattaaggcccaaaatatc

SEQ ID NO: 5106 - DNA, 186 bp, Arabidopsis thaliana
tttctctcactttctcggaatcgaactttcgttcgctgcctctttggggtttttccgtaattgcgtactgaaacagattgtcggagacctttgccacgtggcgtaatctaatcaacaaaaaaggcaaagatcaaaaatttacaatttaacaaaagttaacgtttgtggcagagaggttacacatcg

SEQ ID NO: 5107 - DNA, 614 bp, Arabidopsis thaliana
tttaaattcgaagggttggaattaaccatcaacccttctttcaagtttttgttgctatcattctcaggtaagataccagaagagtgagagcgattggctgccactgaggaggcagaatgattagataattgagctgccacatgagcagaatgatcttgatgaacagagttctccttgcagattgagctagaagatgaagcttgtgaccctaacctttcaaagacagaaggagagtggtgtgctctgtcatttgaattacgatggccagattctcttgctttttcattgcttgatcccaacctttcgaaaacagaagggggctgctgaggtttttctccagaacccaaccgctcaaagacagatggtgaaacctgagactcttctcccggtgaattttcagattttagaaaagaataaataatgaagaattattagtcgttgacaaaacaaaaaagagaattattttagtcacacgacgtcgtttagaatatgttaattttcatcaagtcttggataaaccctagactcgtctctctatttctctatcaaaattcacaccggcgattttgagattgttctctgattggcttaatccgagagaatcaaggaattga

SEQ ID NO: 5108 - DNA, 430 bp, Arabidopsis thaliana
gtctatctatctctgcagttataaagactattgtggttttgtctcttgtagtctcagttttgcttttaagatatttattattactatcatctggtaattgtagtattttggagcaaaaacgttttacaatacattcatgttgcagtttattgttgaattcaagttctatgtttttgacttatcaagattctctttttaaaactcactaacttataaactgtaaacatacaaatgcagtatcttctctaaccagtaaatgatcataaatcgatctatcaccacatattgtttgcatctttcattatccttttatccacatgttgatgaatggagaagtccgagaaatgacgaaaatcagaaatttcttatccacatagaacactaaggcaatgttcattgatcatcaaaagtcttgtgaattgtagccact

SEQ ID NO: 5109 - DNA, 2000 bp, Arabidopsis thaliana
ataaatttacagaagaaaaaacagtcagagaataaatgatataaacagtgctcgaaaatattggcagagacaaatgccccactgcagatgttcactgaagtaattatattgccaaatttcaactgttcttttaactcttttatttattcaaccacatttcacgcaagatacaactaataactctcgtttcagtgtaaaatgcatagaccaagccctacttaattataccttagagttatattcaaaccctctaattaggaaaagaaaaaaagaagtaaatcagtattatactatactaatatattaatttggaatatatctacttaagaagacagtacattcagaagtacatcaataaaaatacgttcaaccttttcctctcgtaagtttatagttattattgaaaattatgtttaaaactttcttcttccataaaaaaaaagaaaggatttacgaaaaattcatcaagaattatgattaaaaccaacttttccaactgcatgccacattgccacgtaaaataagagttgaccatcaactgtttttcttggataaatatagctgtaagaagttgtgaattggttcatatatttacaaaaatttaaatctgctgttgaattgaatagaaaatgcattaaatgcgattatcagccaaccaatattctagtccttgaaattatataaaggtgtcactctttttactagaagtagaaacaaatgaaatcattacaaacgtctattgtttaagaaaatttagctaatcttcgaaaatatttgtttaattattgggtaaatctacattagttagctagcttactgaacttgattatccatctactaacaagataacttttattatagctcaaagtgtagttaatgatttgagaatgaaatcacatgttggttcaagtactatttttaattttattttgagaacccatcttccgtcatacgtacgtgtaattgttttgtttgctttctgttttcgtgtatgtttctggcttgtttggccgagttgtcttgcaaactttgttttggaacttgttctatcaatcaggcaacaaatagtcatccgtaattgaaacttgtaaatgtaggggaataattaacttgaacagggtaactagatatattctctatcagtaccgtatattgaacctagaacaatagttttcttacaataatttgacccgtagaaccaacgtgtctggtttgcttttaacttgacatccacgtcattgtttgttccacatttcaatgtcgacatttttgttaattggaggatttttttgttaaagtttgttggagggtcaatggaatcatcctcgttcccaataccataatcagaatctaatattcttaaatagttaccattaaccggattaccggacgacaatcctatcaccgactaacacgacatcttaatcatcgtcatctacatacaacaaaaacaaaagattttaatcaaacgtaaaaatacgatctatttattaatcccaaaatatcaaatccaaaatataagtataagttaatcacaagataaatatacagtatatcaaccattcagaaaactaattaatgtataatttacgtaaattatatattgatagattctattctttttgtattgcacttctattttaaatgcagaaatagacataaaaaaatagtaggtgacaaatattaaaagtatctgaacgatgaattggatcctttggtcatggaccttatcggggaaaaagaaaggctattaattaaaactctttcacctactcgtataattaacaagttaacaccatcaatcttctctatttaacacaagagcctcatcacatttcattcatcacctacaaagcagagagagagagagagagagataaatgtccaagcaaaggttcatataattttatgttattaaatttgctttttttttgttaaagtgttacatacatcgatcgacttgttagttcaaagaatcagtttaactccactgagccatc

SEQ ID NO: 5110 - DNA, 2000 bp, Arabidopsis thaliana
gtatttctcattttatatcatattatcacttcgtcaaaactatataaaaagttaaatggtacgaaaataattcgtacttaaaacacataataatgggacatacaccacatatcaccaaaaatattaataataatgggacatgcatagaaggaaaaaaaacataaaaactgaggactgttttgatgaaaacaagaagaagcctaaaatggaattcgtaggatattacattgaaaaatatgactgtaataaatttaagaggatatcacttcaaacacttagttaaaaaccgactatagtacatcctattctttgactttatctagttatatttagtatttacatttgtataccgtctatatatgcccaaaacatgtgaaactatttttaatatagaagtgaagatgtgtccccaataattaatgaatcacatatacgtttttcaacctaaatgtgaattatttcgttaattttgggaaatcaagtttttttctgtttccaaagcatatcttataaactcactttttgttttgataatatataggcacctatttgcgaacaaatttttattatgtacacagtacactcaaaagctttatgtagttattatcattgttatagtgcctaagttgctgcttatctaactatccactaagttttttagtttggtctatatcttagctattaactttagtcgagatcatttaactactatggcggcttgacagactgaggctattctttaatgaaaaactctataatgtaaaattctttttcttagtcatatagaattatagatatctatcgtggtttcaaactttcaatctatatagtatataagtgtataagtgacattatctaaacatgtttatatcctcaaagttgtaaagttactaaacttccgaaaagatgatagaaatagcaaccagaaaaactatattgtattgacttttgactgactttagaactcaatagtgtaggccaactcaacctaacattaaatatttatgaagactaattaacaacaatcatagggagcctattaaaatgttaaagtcttgcgcatgtttgactatataatactaacgtatagttgcatttatttcaatgatataaatattttatatctcattgtactacttaagttatagattgattattcgttggtgatatttaagaccaaatcctaagacgacatatatatgtaagtgtaacccaaaaaaatctaaaagtcataaaccgtatgattataagtatatataagatacgtattatactacagaaacacacacatgtgtaacggaccaacatggatgaagaaatggtcccattgagaagaagagatctaatgacttcaaatcaagaatggtccattttccaaaatagacacgtaaatatatacaaagcttaatccccatccctctattgggtctacacacagcctagcatttttgtattttctgctctgtttttatttttttttaactttacaaattactttttaattcttattatcttcagcttttgttctgtctttttttttattttcctgataaattctcacaacttccattcatgactcgagctgggtcctttgatttgtcacagctaatcaaaacagtattagcacaaaaaagtgtatatcaatatgaccatgaagttcataaaaacatgggacctttgaaagatgttgtctcacatattcatacatatttcaataaaatccattacgtacgattccatataaattattggtcagtcatgctaaatgtaagcaagcaaacatatcatttatggtgttacatcaagttatgacagagtatgattgaggccagaaagtaacttatgggtctaatggatcgtattccaaagtaatgggctttttattaaggccgtaagaggcccatttatgtgatttctttgaagtcgctttgtttgcaagttgcgactactcagtttcttctccggcgaagaagaggataacgaaaagaaaacacatagct

SEQ ID NO: 5111 - DNA, 549 bp, Arabidopsis thaliana
ttatcactttaacataaacaaataaaggatagttaaaatctgtttgtctgtttgtttttctctcttttcctgaattctgtttatgttaattagttgttaccatgtttgtcactctctgacttagtgtaatactatttaataatttatggatttgatttcacaagaaaatatttgaaagaaattgtttgattatgtgtggacgtgtacaaaatatggttaagagacgatccataagtcaacaaggtgcatgagacattctttgacacgagtagaatattggcacttctagtattggttccgttatcgaacaaaaccatctttacatgcatttgttagtaagtagcaaatcattagctaatcaaaataagaaaatataggatcagttgaatttctaactcaactaaagcaaataaacaacaactccactccattctcaccaccttaaaccaaattctccaatgcctctttatataaactcattacaccttccatcaataaacatcaaacacaaaccaaagacaacttgagtaaccaaaccaaagactaaaa

SEQ ID NO: 5112 - DNA, 349 bp, Arabidopsis thaliana
gttcggatttcaagtgagattgagaagatgaagaagagcaagtttataaaaccctgaacaaaaaccccgacagggttgttctatccaattttaaaccttaggggtgataatttaatcaatcatataaattaggggtaatcatgtaaattaacaagattagttgaagaagaatcgtcaaattttgattttgtcttgtggattcttcaattcaaagattataaatttattgatgaacatcgtcaattcaaagattctctttttatcattcacgctacttcttcttcttcaatcgtcaatcgttgaatccgattcgatttgcctctcttccggcgtagcttcgacggtggca

SEQ ID NO: 5113 - DNA, 2000 bp, Arabidopsis thaliana
tccattagtattttatgtagtattcttattaagatattttaacgtggtccatcattctacttaataagtttttctcttcttttaaatttattggcagcagtttgagaaaacgattagattgattaagaatgcaacgaatgtcaaatcccaaaccattatcttataccagttatattatgagtgcttcatatttatatattaacttgccaaagttttgaagattatactatgaaggctactcaaagggacattgattcctagaagatgattttatgatgttaagccgttgactttggtaactaaatcatttgacctttgatgtttctgccccctttagcaaatagaaacttaataagaaaattttcattgaaatttagcatcccaaagaaaggtgtagaaaagttatagtgtaatgtgattggtgaggtgcatgttcgacactcttcaaatgttgattgaaacttttttttgtgtgcaaagttgattgaaactttaatattttttcattaatcgcttaaagtgtagtagtgtcaaaatattgagatgtcaagtatagaacatactatcattttcaaaacaattgtgcaatttcagtataatcagtatttaaatcattaataacctcatgtgtaattaactctattatattatcgattttaaaacacaagccccaagacaatgtccctcattctatctcatcaaatgctcaactttttttttttagtaagaacattaattgggtgcattaatgaaggtcacagaaaagaagggttatagagggtaaattaaaggtgattgcacacaaaagtatgtctttcagtttttcacagaggaagctcatgacactcaccaaagcagcacgaatgaagttcaagttcttaattaggcttcacatactctacatcatctcctcaaaatttatatcatttcatatgttcgatcttgttttcatgtgactctctcctcttctctaccgtgagtctcttcaatttcctaaccctttgttaacgatcatatataccttgtttctcgccgtactatttcatcccaaattttacttttaccacttgcgataatatatcatgaagtctcttcttctccttgcctttttcctctctttcttctttggctctctcttggctaggcatttaccaacatcctcccatccaagtatgtatctatgcacatctttcttactccagctctttcactatcttcaagatctctaacttgttcatgtctgcgtgcatgtgcaggtcatcatcatgtaggaatgaccggggcattgaagcgtcagaggaggaggccggacacggtgcaggtggctgggtctaggttgccagattgctcacacgcgtgtggctcgtgttctccatgccgtcttgtgatggttagctttgtgtgtgcatccgtcgaagaggctgagacttgtccaatggcttataaatgcatgtgcaacaataagtcctaccctgtcccttgatcagcctcttctacacttattctatgcattcaaccgttttgttttccttttgcttctccgggacatgaccatgtgtacgtatacaatgcatctttaattagtttctttcttattattaataggaatcttaaacacagtttgatccgagattaattaatcagaaaatatatggatatcaaaaaatgaaagccactcacctatttgggctctctcgctgtattatggtccatgaggccgtatttaagacagcaacaacaaaagttgtagacagaattatatttaaaaggcaacaacaaaagtacgtatacgttgttaccaccaaactttggaggctcgctaataataaccacactacccatttgttacacaccctttattttcaaccatatcatctcaccttcgttaaatgttcccacaattagctcagtattttactatatacatacacacacattccctccacaggatcaaacaaacacacgagctttctcctctacaacaaaataaaataaaatta

SEQ ID NO: 5114 - DNA, 2000 bp, Arabidopsis thaliana
tctctattcggaaccctagtctgaccctttgttcaaaaaatcggccgcctagccgggcgcctaggcgctaatcagatgggatccacgacaatttttttcaaatcgagaagattaatcgttgatccgatttttatccgtatagacccgcctaaatccgtctagagggcgcctatcccaaattttttttttctaaaaagaaaatttaaaatttaaaatatccaacttatgttcgtaatttgtatgaaaaatcatatatttgaacctacaatcttattttcatatgtttaatataattttaaaaacaatattatataaatttcttaattataatgaattaatatgttttaaaaatattaaacaaccctaaaactaatccctgattaatttttgtataatctctgatttttttgttaggcgctaggtccactcttactgcccgactagcgcctaacgattttttgaacaaaagtttgaccagataatataaaatgatgaaatctagcttgacgagataataataaacttttcgcatggatctgcatttttttgagtaaaatagaaaagtggaaaaatgaaaaaataaaataataatatattaactgtttttattatataaattttacttttacgcaaaattatatattaaacgtcacataattaaaatcccttaaatctttatcctactgtatgttctgaatcgggcttttgtattttgattcgtgaaaagtctttcacttcaccggaccgaagatgattcgtgaaaagtccacatttcacatttctcaattcacacttgtgctttcgaaatgggcttttaactttggtcctaaagactttctctcatctatatgtctctgaattctaggacacagtcaacaagtcaacgtcggtaagagatcccacaacaacatctacacagacacgtgtacactatctctcactttttcaccgacacgtgtcggttctttcacctacaagtaaaactctctccattatcttcaataatgtcaaaaatgtcacacacacacttagtcatagtaatacccaatttccacggcacctatttgccatcgaacaaacaataaaaaactttattagttttcacaattaatacttttaactctttcccgagagtcgtaagaagagaaaaaacaaaacttttttctttttcgttgaagaatttttacataaaagttttgtagattctctgatcagaattgtgtaaaaggtattctctttttttttacttgttgaagaattaaagtaagtaaataattgatttcttattggagggacccttttgttgtcatagaatttactctgctgcgtttttttttactgttgttgctttgttcttgttgtttggttgtatattgttgatgctctctctctctcgttaggtgaagtagatctctcttttctctttctctttctcctctctctctctttccttactcagcttttgtggtgaatattgaagaaagtttctctggtgaataagagtttgttcttatttttatgaatttgttctgttttcttgttgatagtttttgggtttgataaagttgtttcctttttacttcttttagtatctatctttccaattctagtaacttcactggttcttgagctctttcaactttttgtttcagatctctctgtgtttttttctgatctttctccagtggtagcttctgagttagtgattgtactttacttccatacttcttgttcttgctcatagattttagctgtggttttgtggagttttagctctcagtgattgttttagttttagttccttaaacatgttttgttcatatgggtttgttagatctttgagttttcttcatttctttattatctctcttggatcttgatacaaaagtatgaatctttagattgcttcaagaaaaaaagttttaaagactttaagagattcttagatacatagaatttgaagatcttgtattggtttttgtgaaacagatatttgttag

SEQ ID NO: 5115 - DNA, 692 bp, Arabidopsis thaliana
tgaaacgacgccgtacaaaattacttgagaaaaagggtaatttagacatttcacaatacaatgcgacccattatcacttcaggtcctcgagtttttccccaatatcaaaaccactcgacgaacaagaaccctagaattcgcctcctctttccaaaattcccaatttttgtaatgacgggatagaaaaattcccaatgtccgctttatctttcattctcgattagaattcttcaaccaaaggtcactctctctccgttccattgcttctggatttcgtttttaaggtttgcgttcttctttttcttcttcgtcttaagagagtaaaatctggtgttgaagaatctattttgagtcggaaatttgataaatttgtaatcttccgtactgggttttgattgttgtcttgtctctctaattgtttcattcttcttatgctacgaatttagggttttacatttttcctgccttcttttacccatcagaggaagtttcaagccattttgttgtaagtcatctttaaacttctagctcttttggattgggtttgttaaagatttaagctttggttttaaattatatagatttgctgcgttgctttgctaatttgtctgatttaggttttgtcctctgcgatgggtttctctaattttatattcaatattttttcagaatcagctctctcataagctaag

SEQ ID NO: 5116 - DNA, 756 bp, Arabidopsis thaliana
gtgagacgctctgcttcttgttttctctttttactctcttctaataaaagaaagacaatattttacttctcttaacgcaaaattcagatgctctacattgttggtgacttggtgtgatctcttttttgaatgaataagtacttctttagttgattatttgttggttttggttaacctctttgtgaggtaatacaggaatgtcatcttgaaaaatactaaccaaaaaataaaaaatagagaatataaaaccttatccaaaagtagggagattgtgttatttaaaagggaaccacagaaaaaaataggcgaggaaagaccattaagccgttggccacacaatcagatatcataatggaaatacactccgatgactacttcttccttcctcctccctgcttctcctccctcagccgcctttctccggcggcgcttcttccgccactcctggctttcctctaagatccaccaccgtcttccccaaggtacattactactcttctctatttcacctgtcaccacttctctgatctttggattattctggaatcttcgttttatgtgatcttgttacaaaaagtttccattacgattccatgttttaacccttaagttcaaaattgtggtacaattctatctcataggtgttttgagttgaatgataccttctgattttctggagccctattgattgtatatctcccactctactcttatcttactatgcaactatcctgtctttctttacttgcttcagtt

SEQ ID NO: 5117 - DNA, 2000 bp, Arabidopsis thaliana
attctcctttatggatcttcaacattgggtcagagaagtttaggcggctatgtgatggctatagaacttgatatgttatgctatatatatatatgtgtgtgtgtgtataggtgtcgtaaaccctaattatcattttttttagagtgtgtcagccttgtcaggtgtcacaacatctttggacaacaaaatttcttacccttatcatttactcaatatatcttatcccagattctctttatttcagcaaatgctatatattaatctaattattattagttgattattttattttattttattttgtcttttttttttcttgcacacagaatggttttgtttataaaatataaatgatttttaaatttaataattttagtttcaaaacattttttttcaataacaaactacctgaaatgtatgaattctattatgaaaaatgattcaattatgaaataaagtagtaattttgtagtggtgaaaacagtgaaaatgaaagtgccggaagcttcaaaacttaaaacatatgatgccattatgactccgtttaagcttggtcttcctttatctcaatatgacgctcttattcgcaaacttatgccaagtttgtctaatgagttcattcatgtagtgtggctacatgacatttttggagcaaccatctctgattttcatgtagtgtggctacatgacattttccttaccattaatctcatcttttagtatcacttacattaaattcctcctttatagaatgtgttcaaccatctctgattttcatgctttggaagagctctttctgtagaagattctcgattaatggtggaatcggcctcaatggctattgttgatgctagaagaagaagaaggcaagaagcccaaatgcattattgccttatatgatttgtaaataagttttgaagcgttcgttaagcggagcttggcatgctcattcccgcatgatgaacgaatctatgaaagatccctttttggaagaaaaatatttggattcacctttatattcactttatttattttagtcaattaaaatctgacacctaataataataaaaagaatttaatttaattataaaatctaatttttcactaaaacgaaattatgtatcggtttagatttattagaaaagatcagggtttagatatcagtttgagtttagaaagtacgattagggtttagatttatagttaaacggattatatattggtttacgtttataaacatatttagattttacaattaaacgaggttaaatgtcggtttgggtttagaaaatatccaagtttcagaataacttaaactgatgtgagatgttttaaatgcacggattagttcatttaacactcataaaattaatatacatagtataaaatatactcgtaaatttgatcatgaaatgatgaaaccatatagttagtcggattatcatgactaactcatattcttttctttttatatatataatctacaccatgaactaacatcacacaatttttccaattaattattttatcaaaattaaaaattacaaataaaaatcaaaattgtgatgatcccttgccacaccacgttatagtgttttcgatcattaacatttgttggttttaaattttatgtctaaagtatgtaaaccggataatattagaacaatagctttgtactctgagtactctcttagaaactagagattttggttgacaaaaaaaaaaaaaaaaaagaagaagaagaagagattttgacttttcttggccataagttaatcaacaatttatgtccaaacctaaaccacccaaatcggcttaagtccccaaaaatataataaacaagtgatcgataagagaacaagttcaacaacttctcaatcctaagaaatgcaacaactacacaaatcttccgtatttatacacctattgatcaatctcaaatccttcaatctttcctacaaaacaaaaccaagaatcatacaaaacaagcatcctccaat

SEQ ID NO: 5118 - DNA, 890 bp, Arabidopsis thaliana
ggttttcctgtaaatttccggttaagtgtttggtttagactcggtttgtttagatgttttgagtttcgtgaattgtttgatgatcactctaatggttcaaaattgatggttgaatttgattcttcttcttcctttcagtgatttataattgttttatttaacgtttgagtccctggaatttggataatatgcaaattgctccatcaggtatttataaactaatttctatccatcaattgcgttatagagttgcgtttgtgtgtgacatcgacaaaacaaactaaacgctatttctctaattagtggattttattacaagagaaacttgttatatcgtcgtcttctacaccaacaggccgttgaatcatgagacgctattgataagaccgacctaataattaggtagatttttttggtgtagtttatttccagtctattattctcagcccattagacccaaaaggaaaatatcaaggcccgtaaggaaagtctaaaaagataagggacacgtgtacagtcataaatctatctaaaggtaggccgccacatctatcaccgttggatattctagtttaaaatcgtcatcaatcataattattcatttcttcttcgtcttcttcttctttctcaaattagcttttctttatcgtcttcctcaagcgtgagattcgttgtggatatagtttttctccttgattctctggttctttccatgatccaattttaagggtttcacggcttcgtttttttgggtatatctagctctatcgttcgtggtggttttctttctggatcaaagttttctgagatctctgcgatttctgggattcgaaaattggagaattagggcttttttacggtaacagggtttcgaagagcataagataaga

SEQ ID NO: 5119 - DNA, 1969 bp, Arabidopsis thaliana
ctctgtccgtaaacttgatttcttattaaaagatgaaaactttgtgagattttcagagagactgttgatagaaacaaaaacactgatttgttgtttgttagttggatcctttgttgcttttagagtgtgttgctacagctctccgtgttaaagcaacaagtggcttaaatagaaaagagactattaatgtaattaattgcaaaatttgcagagactattgattttaaaggtgtagagtttgaaatcatgtacccgtgactatccctatccctaagactagtttgttaatcatttgcatagtttagttttgttggtgttgaataaactacacaaatcttaagtacatatacaaatgtataatttgactatggattggggagatacatagatcaaacagaggtgacatgtgtcgtggacgagagatgttcgtagaagtaatcacacggaaccatgatcattgcccatatctacgcggtattttaatgatataaaagtaagatttgtgggatatgaatatggtcggtttgagaacatttaaggacttacaattattagtggaaaagatggagacagacaagtgaaagtgaaatactatgaaagtgaagttatgaagtttcctccacacactttttagtgaaacacagtttgcatttttgttgagattttagaatcaaattttggaattagcaactctgctattaacttatgcaatggatgtgcgtctaggaaaaatagatttcggattttaacccacaaaaagacaaaatgatgatcactaagttaccattatttagtactgctttaaacaattttcatgtttgataatgaggaaatttagtaatttagaacattgtacaaaagttataaagaaactcttagaaagatttagaaaaatgggctttgcaatgactattgagacggtacgtgtatccaatagtggggttggtggtctatggaagtggtgtggtgcatcattgcatggggttggttaaatttaaaagtcattcatttgtgtaatcatggttctctgtttccaccgtaacccaaactaaattgttgacaactaagagtttttaaacaagtaaatcattattaacttgagatcatcaaaggtaaaacaatttctatgcgtccaaacatttacattagtatggttctaaccattgttctcagaggatcttacataaaacttgatattgtgtaaccggttcgcgaggcttctagtgctaaattacatttgtatgttttttttgttgacgtaaattgaaaactccttcattgaaaaatcgttggccgaatgttaagctaggaaaaataataataatgaactaggagccactaacaatgtgttgaaatttaagtcgaagtcgacactgaacacacacacattttataagcatgggtgaactgcatgagacccacactttacattacacaagtccgagaccgagatgggattagtaacctcatgtgcagtgtcaccttcctaacttgtaaaagtgtacaaccttaggagggttgtttattcagtctgatggcccaacaacatattacaatttacaacaatttgaatgggtcttataaagctacaaataaaaataaacctaatgggcttaattgggctctctcgtagaattaacaaaaggcccgtgatgttaaaggcggtgtgattctttagggcttcctcaaaaccctaatctcttaggtataaattgacacaacgcaccaccttccttctcatcttcacttcttcaaccttttccactcttacgattccttaagaatctccttctagcttatcttgtattaattttgagttttgtagggtttaggttgtttgattaagttagcaagttagggattagttacgtgacgagatttctctccaaggaatctattactaaaaagatggagcaatctgaaattgtgattgcataatccactagtaaacgtcacaaagcaattgggc

SEQ ID NO: 5120 - DNA, 1731 bp, Arabidopsis thaliana
tgttccaactctctaggaactcttcactcttttgttgttgttgtgttttttttactttacgcagattctgattttttattttatttttttttctttttcaatcatgtttaatgactattaggtttagacaacatttttaacgtaatttataagttaacaattttttttaatttaaacctatttctgaaaaattgaaattgaaccaacacttaaatatattactgttcttcttgcgttctccagaacaaaccgatttcgatatcagtggacgtaagaagtaagaacgacgtctagttaaattatttgtgaaacaagtccactccaaagtctccaataacataattaattagtcctcgtgtgtccgtgttagtgtggaacaaatatgtggtcggtactcgatacataaacgcaagacttgcacaattgccgagtcaagctagtatgattggcccgtaccattgttataaatcattaagcgcagtatatgaatttcttttgatacccaaaaaagagtatatacatatctcctcctttgtagtttttataattatatgatatatatgaaaaaacaaagaccgagctggtaccggtctctagactatttagatctttccggaaatagtgtgtcaatggttggtaccggttcagaaaaatttgacacatctacttttgtcgagctgcaacatcaccgagttccccatgtatatcaaggacttacaagtattatggtggttagacatttccaagaatagaattaaaggaagagtgcccgagttgtaatgtaatctgtcttctatggtccatgtaaatctctctcacaactccatcgtttccttggaaggtacgccaaaaataatctttaattcgttaatttcagagttagatatgagttcaaacgcctttcaaggatattttcctattattctacctaacacccacataatagctgcatcaaataataacttcactagcatccctcttacattctacaaagcagtttgactgactctccttgatctatcaaacaacaacttcaatggttcaattccaagatgcttgtaatatgctacaacgttgaaaacattgtaacaacaacctcaccaggatactttccgacatggaaaatggcttagtactacttgatgttggcaacaaccaaataagtgggaagcttccaagatctctagtaaactgcacaagcctaaagtttcttaatgtagaaggaaatcacatcaacaacactttccctttctagctgaaggctttgcagcgtcttaaaatcattgttttgagatcaaacagattccatggtcccatcaacaccacaaacacaagagcaagaacaagtgttgaactagaaagcagctgcaataggctatggacccttgctcgatgctctataacttgtttcactcacctttgagatttttcttttggtgttgaatcaaatgttaaaataatctttagctttttgggctttaataaactaaacaacaacactatgaaagtgaacgcacaaatatatttgactaaattgtataaaaaaatgtgtgggtgtgattgtgtgaacaagcgtgtgattgatctcaaacgcaaacactaacaaaaaaaaaaaaaaacatttcttgttgttgcgttttccagaacaaaccagtttcaatcaaattctgttttcttcatctccacaaagataactaaatccgatctcgtcttcgcaatcatcaaccatca

SEQ ID NO: 5121 - DNA, 2000 bp, Arabidopsis thaliana
attattttttcttgattgtttatccgattgatcttgtaagagataacttttgattattacataacttacttcaacatgttaaatgacacaataaaatagacaatttatttttgatatccttttgaaaaatattaaataaatatttgtaatgactgtgttgcactaaaaaatcgagataaccccatgagtgataatttggtaacataatctaaacttagagacaattaactaattaagttattatctgagaaataaattagacaatatttttattcgtgtgtgtaatttttgtggtataatattttttcttatattgtttcaattctacggatgttttggataaaaaggttaatcaaatttataaaatgtaaaattttgcttgaacaaatgaaccaaaatgtttactaattggctaattgctggaaaaaaacagttatataatttttgttaacaaaaaaaatgtttgatgtaaataattaattcacagctaaaagtcaatttcctcatttatttttgattaaagaaagtaataaaaaacaattaagtataccattcgctgtacaagagtcgtttagttctgtcggctcgacaaccgactcaagccggctcgagtcgctaagtgaatccactcgctgtctgtcggtggacaaagccggctccaatctgatcactctctctcaccagcacacacacagctctctctcttccctctctctctcccccgctttatactttgttgagtcaaaatcacagacgaagaagaagaagaaacctctctctcactcctctctcctttctctcgtcttattcgcttctcttctacgtaacagattgttcatcttcttctccttgttgcattgaggtgagttcaatttgatctatcaatgtctaaatgcatgctttttgaattatcggatctcttgtgtttgatttcattgatagagatccaattatgatctagatctgaagaatcctgttttttgagttcctattggttaaaaagtttcctcatttagctttagttcgaatctggaatgttaaacgattcggatcgagatttagcagtagtagaattcagttaggtagagtgatatttttatactattagtcttcaattataatataattgcattgagcttttcctacttcactgtatcgttttctattgtaaagattgatcctttttatatattatgcagggggtgttgttgatgttctgacgatctgatttgagtagatctgggtagggggcaaggtctctgggtctacttttgatttgagaattttttaagtgaagtgaagatatgacaagtgctcttggatggagatttccttccactaatggaaatggccttgccccaagtgacacggtaataattacttgattcagtattaacattcatcacacgggtttatggaaaagcttgtttagttgatatactgcaatctttctgagttgcaaagtcagatctggtgtattagcaggatgattaagctgatatgtcccttgcattttgaatctgatttgaaaaaagtacttgagctaagtccattgttaattaatggctttgtaccagtcagttatatctgatagagtgtcatgataaaggttatagtttttccattgcataggagcgaaaaggtcttgttgctcttttaacttattttctgttgtttggtcttgattgcaggagagaaatggggatatgaagatgcatgattcagagcccccaactccacattcaaccacaaagatgagtttgaggtaacgcatatatgtatttggtactgcatgggagctaatcatcgtgataaaattgaggttttatctgtatttgttgcaccaccatcttggtttaacaatgcctgtggaaattaatattatctggattggtttcctatgttatcctttcaaatgagacattttaagcagaaaggcacacctattagcgaattagtatctaactttccccatcccctgcagagaccggacaaccagc

SEQ ID NO: 5122 - DNA, 2000 bp, Arabidopsis thaliana
agcattgttttatcgctttgtcatcggaagagtgtggttttgttataataaaactcgtaccaatagacatctaaatgcagattcatatatatgtcagaaatagtaagaaatttaaatttggaattcaatgcatatatatgtatgactttttctttgtatgaaatgatagaattgtgttttacaaaatcatgcttttctcacattttgtgactaattctaccgacttaatttgtatgatatatagacttgtgtttacaaaatggcttggtttttgcaaccgagctagctcggtgttttgtggacgtacgacatctccatcgagaatatgtttatgttttacaatccacaagtattgtgaaaacggttttatgaccacaaataaatagtgctagtattgataattctgtatacgtatacgaattattgataatattacaactatgaaattgcagtctatatgtacaccgcaaaaaattagctaaatgtatgttaccaccattcatgactacactacatatataataagtacattttcagctctatgtataagaaagttatatgtcaaggcaaaactaaaactaattatgattgggacagagttagactcagacatggtcacatatatgcacatccaaacgttgatgaacatatatagaaattataccagcaaaagtgtaatagaaatgaatattaaatatattttattcatgccaactaaattagttaccttcaaattcgatctcaatgttcttaccgttaatgttatttcataaaatttatagtcaattttcatgaaatattttccaaaaaaaaaaaaaaaaggaattcctcaagtggtttttggtaacggagatcaaacggagagtgtgaagattcttgtccgagaggagctggcaaccgacagagttgctgcctgtctttaagtgcatttgcttaactcactttgacggacaccggatctataagttgtcggtaataatggcacgtgtcatgatctcaacggctaagcttttttaatctacttttttttttttggtcatccttttataatctacttttttttttaatttacggtgatgaggtacgtgatgacgtaaattggtagtattaccctacttctaagtttaaatataatcacttcgtttatatacatctacatttgttgttgaaaacaggttgatcgtaataatgtctattactttatctatatatatagagtaattatatgcaacgccacggatgacaaaatttcatataacaaataaaataattatgacataggaatatattctccaccaataatttttgcccttataatataaaaaaatttaccaaaagaagaatggatatcttgtaatgctttttctataattaacgatacgcatgtactttaattaagcactttggtctaggattatagactattataggtatagagagaaaaaaaatggctaaagataaaatatataaaaccccaaacacagccaaactatttattatcagttcatggatatagaagaataatatataaaaaattcttacgtcttttttgttattggctcctgatttcataaatttagggtttccaagaattctccatttcaatcttgccgactctttccaaagactctctctctttctactctctccctcatcgttctcttagagacacaaatcaatcaaaagcatacataaaaacaaagggggtaatcttttttctcaactatatatgtcctcaatttctgattgatctcttctctatttttagtagaaggtggagattgttcttgttctcatgtttgctgttcttgtagtaagaaatatgtctatatatatatatatatatatatatatatatatataattaaataattgctcccatctaatttcctctcatggataatttactttactgaaattaaattttttcatttaatatcttatgggaagagtggaaaatcaaaatactgttgttgattagggttaattaaattagaaga

SEQ ID NO: 5123 - DNA, 2000 bp, Arabidopsis thaliana
attgccattgtgatttttcaaaaataatttaaatttgattaactagatgttaaaatgagtaatcggttcatggattaaatcactttataaaatgatctacctccatcataacctattagattgaaagataggttcagagtttgtgcaaaaaaatctatagcatacacatctgaactatttctctttggtcaaagaatcctaagtctatttctggtattaaagatgacatccgaaaagcccttttaaaaagatattcaggaatcagtataagatattctgagggaagtcaatcagaaaatgatatttggttagctctggtggtcaatataattgaaaccctcaacagtccaaccataattgaaaacatttgtttttcctaatcgatgatttccacgttttacattaaaattgtctatttctaacactgtagagtgattagtagtataaagatagtttgaacgtcaaatattatactacatactgtttagtgctgactcttgtccaccttataaacatctgaagtcaaaaggatgctgaagtcattagagtaaatattgagaggaagaagtcttatcgtcgccccatttcacttatcattgggtgagatcggtcttgaagaaagagagttagagaggaaaaagaagaatcttattagctctataatatctgatattgcttctcatttagtttttcactttttacattaagattggttgtttgtaacattatggagtggttaatagtataaagataatctgaatattataatatataatgtagagtcttgtccacctaataaccatctcttcaaaagcattgttctatgatctgatttttcggaaagactctgcacttctgttgcacttctgttgttggacactttctctttgctaataaaccactaacacaagtccaagcgaccagagaatccatttcttcttgttttattagagcattcataataaggccaagattataaatcatccgaaaagcccaagtgtcctatgtaatttattttccaaagctcatttaattagatctaagcaactaggttcatatatatatagtctcttgtaatgaacatcaaatagttaactttgaaagcaatctcaaaacattgagatttatgttgttaaagagcttattaagatagcaacacgagattgaaattagatagcttattaaagctttaattagctcacacgaaccaatgtgaaatggggtttgttgttgggtccaagtccaacgaaacgattatatttcttggatggtagttttaataatgggcctgaatcatatgggctttttgatgagactgtgacggtaagaaaataaaaaagggcaaaaccgagaaaacagatctctctgtctcaactcaaacaatcaaaagccctagtaaaaccctagcccccaaagcccttgtgccattgagccgttatataaatccttcactcgctccttgagaagacgaatttgagattgcctctgcaaaggtacttcatttcggtgaacccaattcatgttttcgatgatttttgcttctctatttcttcgattttgcgttttatcgcgttaaaagcacatatcgaaggcttgcagataacgtataataaaaaacgcctgcgagctcaatatttgtgcaatatcctaaaaccatccatttgaggtttcgataaatctctgtgttataagaatttatcttttcttatcgacaatttcgatggatgggacatttattaatcggttttatgatttttaacattgtatgagaaaatctgagtcagatctgaataattgaatccttattcgtctgcattgatcggaaaatagtaccacttgggttttatctagtttactttaaggtgctcatagagtggtaatctcacaattgttgttgtttgaacaatttgggacctttgtttgcatgatttagtctcttatataccaattagaatttgggaccatctgctgattcatatctttgtaattgacagagtaaa

SEQ ID NO: 5124 - DNA, 2000 bp, Arabidopsis thaliana
tgtgatgggttggatttgtcatatgttttctctcaggcagtggtactttttgctatgggtggctatggaacatacctaggcttccggattcgttattctgatgacattgtaagactatttacccaaataatctgactatagtagtacaagaagcgttgttgtttaaactgttttcttcatttgccttgaaattttcaggaggagaaggcaaaggcaaaagacctgcacccaaagcttctagccggaatgtttttctttttcgcccttggagcaactggtggtgttatatcccttcttacttccgacaaacccatcttcgaaaggtatatttttctgacctagtaaactctcatttactgattccaaacttgtacaaacaacacttatgctatctagaagatctcttttaacttagtaatgagatatcaattgggcgactgatatggttgcgaatttgtgcaatgtagtccgcacgctgttacaggacttataggtcttggcctattgacggttcaaacaatcttaccatctttgttcaaggtaaagtacttgcacgatcttgcaatgtgaagccttgatgatttattaagttataggatcaagaaactcgttgaatgtgcaggagaaacccgaactgaggaacgtgcacgggatccttgggagcgggataatggcgcttttcctcgtccatgctgctttcggccttcagctcggtctcagtttctaattattctttactgatctcttctcttatgtttgtattcttcagctgcaaccacaaccatttttttctttaaagccttaaaatttcaataaaagaagatatatagagaaaaacgcttgtaaactaatgtcttatatatatactaaggatgtttttattggctgctaatctgctactactagtcacatatacacaaagaattttacttcctagagtttttattttatcttcagaacaccaaaattaaactaaatttcctacaaacaaacataaggcaaatttagcttctccaaactttattaaaaaaagttgattaaatgaattaaagagtttcaaatgcggaaattaaaataaacaccatcaccaaccaacatctttatataatgaaaagaaaactaattaaatccaaagaaaaaataaatttattttattttcgaaaaaatctaaaccactcctccttgatttgatgccagcatggtccatgtggtatccaaaggatccggttcggatatataaccaagatctaattacgatgtcaaaatccgggtcgggtattgtcgggtattactcttctctctcaccaaccacacccataccaacgacaacggggttggtgagattacattagttgtctacatctcaccgtccattcattcttcattaaaagatcaacggtctaaaaacatgagaatactgtagatcataaaacacgtgatcagagctccggcaacaatataaaccgaagagatgtgaagcacgagagaagagcgggcaaaacaaacagagagcgagtcacgcgccgagttttcctcacttgttctcaataaatctctctctctttcttctctatcgctttcatttttctcctccagatctcgattccaatctctctccctctctacttccttcaacaggtttggtttctccgatccatcgtcactctcttcgttagatctgttcatttttgctttggtagctaatgtaatcactcgtttcgcgatttgaaactagatctgacgctcggacgttgtttccttagatttgtttagcttaattgctcaaatctgattagaaattgatcgaattagattctgtaactggaaaattttggaatcactctgcagaaaatgtgtcggtggaagtgaaactatacattttttttttttgaaatttgttgcttaatttttcaaattcgatcggaaattgatggaattagatcttgaaactggaatcttcgcttgtgtagtgttgattttgtttttgtgtatgtgtagaa

SEQ ID NO: 5125 - DNA, 1345 bp, Arabidopsis thaliana
tattagtgaaataatcaagttcttttttaagttctatttcgaaaccatagcctaattaagagtattaataaggagacaagtttaagtgtgatctaccttgaggtttagtttttattgtagacaaattatagtaatggttttttaatgatttcaatgacagtttagaagaatgtaactctcgatccaagaatgataattcatgagttagtaaactgatgaaatcaaaaaagaaatgttgtttcaattattatactgtaccatttttatttctacgaattacgaaaccatttcttctctaccgaaactaaagtaaactaaaccgtaacaaaaaattttgtttctttgttttcaaccgtatccaaattatgtatccagttttttttgttttttttttttttttttttctcattgttgacaaaataagtaattttctaatttaaaattttcttcaaaaaaatttattataatatccgtaactacaatgcaaatagtgccgtacacgtgagaagcaaaacaaaaaagatgcagaaaaaaaaatagtaccacaaaatccttcaccaaccgtactgcgaagccaaggcaattgaaaccaaacactgataggcataactcaacagtagttacccttttttgaccatcttctcgtttaattctcttctttattcattttcaatcttactctatccacacacacacgaacacatcaaaatgccaccattttacatctgatttttagtcttcattactcatatttaagcttaagttaataaccacaacaaccaccttttcatgtggtttatttggcaccatccgtattctaaaccgttcgtgttctttccttatttggcaccatcaagattctatttacaatattttttttcaagtggcaaaacaaaaacaaattacaatttttataaattaattgagttaaagaaaattacttccaggttccattaatgtatctaaaaatatttaagtaaaattttaattacaataacatccatttattttatataaaaattttaaaaaacgttttaatagattcttttaatagttaccaaaaacagattctgtccagctcttctgcaccaaagtacatgcttagactcaaagtacgattttagggagaaaagaatttgaatactggaatagatacatgtttgttccaaataatttgagtaactttaaagcatatgttatacacatacacattttctagaatattagcctctcatttctctccttatataagccaaatagtccccgcttcttctcattcatcaaatcctcaaacaacttcaagaacaaagagtgcttttcgaggcccaaaacacattaccataaa

SEQ ID NO: 5126 - DNA, 1797 bp, Arabidopsis thaliana
gtttggtaaatctactccaaatgatcaatacaataaagaagacatatccaacctaaaattcttggccaataacaaacagtttgtaacgattttagatgtttcaattacgataattcatggtgtggtccccttaatcatgtttaaaatatctaaacaaattattggtaaacgaatttccggtattgtggatataacccgaccggttgagatctggcatgtctcataacatggtcaaattatatttttttcgtatcaaattattttgactagtcaggtggccgctgttcggccacgtagcccaatcccataatcagaaaacaaagccgtgttgtgtgtgtgttttccatcgacatctcttgttaaaccaaatctcacaattattcctaaaaaaaagcttttttcctttcattttaaaatcttttatacaagtgtgtcaatttgatgatgaatctttttttttttttttttttgttttttttggagtttctcggccaaaacccgtaattcccccagacccgaaaccatagcatgtaatattagtttcgttccaagcgtcactcgaaccagagacctctaagtttcgtctaaggtttttaccaattgaactaacgacacttggtagatgatgaatatccaaattagctcataatatcttacattttataattaatgcaaataacactaaaacgaatatcatcaagagttgacattatacatgttcagatcctctagcacaaataacaatgccaccttcggaagatgtttaatcacgagtgatcgactctagagttcgactctatctcccatacataaaactaaaaaaaagttgacactatacttagttaaatctagtgttagttccttttaaatgttatgtttttattttatatatcaatgtctatgataaaatttacgaatgacttatatcacttcaaacttttagatttattttttggattgaggaacttttacaacttttttttaaccacacatttattaaatttgtacaattttaaatacacagatttgtaataatttacatttttcggaaatattgactttaattagtgaacgaaaacaaagtattataatttgtacagctttcatttctaccaatcacaaattttttatcaaaaacgttgcacaaaaatttactctcagctttattgtataactttctcgtacaacttttttttacagttttgcactattctgaaaagcttaccgctccagctaacagataaaatttttatacagttttatgttaccaatcggaaccattagttttggttttgtatctaaacttagtttttttaagttttcagttccgtaagattttcaaattttattttatttggactgacaaaggtattaattctataaattgacaaaaatgtttttatttaatttattatatacataaaaacacagaataggtattggtaatagaccggttcgatttggttctattcgaagaataaaataaccaaccactttgttaacaaaacgcagccgtattaactgtttcgggacccaataaaggaaacgtataaaactttgactccaaaaaaaaaaaaaaaacacacgcctaacctgcttcaatggaaaagtcatacatttacctaaccagaccttcttcgcatcttcgtcttcttccttcgtgatctctcaaattctctcccttttaaagtcctaaatcaaaaccctaaacccataaatccaatccctccattcgaattcttcattctctctctctctctctctcacaattactgatcggttctgaaatttgtagct

SEQ ID NO: 5127 - DNA, 996 bp, Arabidopsis thaliana
ggcgcttcttcttcactcagaggtttcaaaccatcacgaagctcttatccagaagaataaaacgcaacggagaatgaaactacgtcgtttccaatgtttggaagctaaacgtcaatgtttttattaatgggcttatgggctttaaaacaaagggcccaattactttttagtttttaggatttttattttaacatctaaactaaaaccagcataatcacattgaacatgggagaaatttgaggaatatcatgttcctaattttaaagggagtaaaataaagttataatttgcaaaggaatctatgcatataaagttatttttttattttttaagaaattataatctaataaaccaactatatttattattatacatatgtatatttgtcaaatttacttaaaaattcataattttaggaaacaaaaataaataacttatagatagaggtaatctttgaattaactaacttaactcatgcaagagccatgccaacaacacttttaatgatgcaacaaagatttttatttttatagtgatgcaataaatacaaaataattatgtcttcatttcataagattttccatcaattatttttcccaaaaattaattattttgtgttggagattatagacagaggatactttggtaattaattctgtgaaagtagacttgtattttgataatgatgcattaaaaacaatattaagtctttatttcgtaagatttttccatcaattctttttcaataaataaaattattttgatatacagaatattttcgtaattaacaataacatttacacgtgagaagaagaaaaggaaattagggcaaaccacagaacacagcttcagccaaaaaaaaaaagggaatcgaagtgattttatcttctccaccgtcaatacagacacatatatatacactatatacctctatctatctgcaaaacttttttttattgaatccttctaattgcgaaaaaacaagagaatcgagta

SEQ ID NO: 5128 - DNA, 2000 bp, Arabidopsis thaliana
atgttatgcaaaggatccagtgagccagcaacctattcgattgtgaaatgaaaaataatgtagtcgatgggttttgttttgtaatatattttggatttgtatggagggcaatgtttgaagtttgtataatatttatggatatttcgttaggctctaattatgaatgccttctttttaggaagaaatgccaaaaatgataattgaactacatttttgcccctaataaaaatattacatttgagacggacgagattgattagcgattctaccatatttgcaacacccgatttttatcaaaaaatgttacatgcagaaaggtttaaaatagtaataattatgtttttataaaaagaagtaaaataataccaaaaaaaaagttatgcattttttttcatagaaaaattcataattaagtgtattgaaattaaataattttatgaaaaattgtgttattgaagactacaaaagaattgtaaggatatagaggatacacaacacaatgattttgtctagaacgcgccaaacaaacttttttacttattcttattgataataaatcttttacaaaaatcaattatcttagaaataatttgacctattctacatgaatgatcaactccgactaagaagaaatgtatgcctaattctctcttctgtattttctaccacacatctgtgaaaaccaagagaattacaaacactcacattttaggcttttgctaggctttgaagataacacacgtataccaatattctagaatgcttaggtggctcaatgcaaactccataatatttatactatttccagaaccctaacccttaggatctccgagaatcaataagcgggatcttctttgatcttcaagcttatctctttccttatttgttgagaaaaatattcaccaacttaatcgactttcgtctttgatctccacgctaagtcagcaaagctcttcggctcgtcacatcaaccaattcatctctgccatgtcagcttatgcgtctatgtcagcaactcaaccgtctgatgtgatctgatgcagtttcctgatatacaacaatttcctaaaatacaacaggtctctgatgtccatcaactcgttattgttagaatctacatcttcaaaaattccttgtgaactgtagagtcattcgtcgcgtatgaaatttggcgtaaaaagggagactaataggcagaatgtgagtatgggaggaaaaagatggaggtcgccagtacattacaagtgttcataaggtcacactattgggagtaacgggttttggtgcaacaaagataactatttaaaactgattttttaatattgagcatgtacaaaaaaacacggaaaaagattttgtggtgttctagcggatcacttgacaagtatatatgcaagcttttgcgccataatggttttagatgtactttaaaattctgccatattatgttatatatatgagtgttttttgttccatgatctaaatgatgacatttttttttttttttatctaatgcctatctttaaaatattttctggatccaccactaacctcaattgcattcaaaaacgaccaaattggtgtatcatcttcggaaaacacctaaaatatatagaatatcggttcaaaagaatgacctggacctcttttttactcattcacccaagcgaactttgggcatgtttctatacccaatcgaaaatatatcgaacagccaaaaaaacgaatttttagatacaacatatatttgaaaaagttcttatttacaaatcattggtgaaaaatttagacactactcgacacaaatgcatgagtaggtttacccatttgttcacaccaatggacacgttataaataacaattttaatatatctgagcgctgagtactataaatactgtcatgtgttagccaaaaagaacataacacaaaatcctcttctcttctttaataacttttagaaacacaaataaaagtttaattacttttaagcccaacaaaa

SEQ ID NO: 5129 - DNA, 977 bp, Arabidopsis thaliana
attaaacatcattgataataattcaaacgtaaactcctgttccttgcgtttgactcatagaatgtatcaaagcattttgaagaaatcttacgcattctgaagtgtggaatttgtaaatagcaaaaccaaaagacatcgagttactacgagaaaggtcacatatcacaatcaataagttaggagttggaacacttatagttatgtgaactttagtctttattggttatggttgcttttatgatagaagaaataaataatgcactatacagtaaatagtatatgtcatccttaacacgtaacactaaacgcccaagaaatagatgttctattcgattaaaatcatataaaaaataattgaggaggccgtcggttactggttagcaggtggagagaatgtgaaatgataggcactgcatttatatggacggggccatgcaccacatcacaataatcatcatcattaatattgtgatgatgatagccatatgaacgatcatgtaagagatatatggtttaacccgaaactggaacacagagctgacaagacgtacccataaacctgcccaaccatggccattaatgattttacatgcacctcatcttcaagaatcaagagtttagattttacattatggtcttgtcggttttttcaaatttcttgtagtagaagaacaatcgatcacgtcgttttcgatagtgatgttttttaccgttattttataatagggttggtctcaatttgataccaaaactaataaatttgccaaaattgtatgaagtcaaaggtatcttctcaatccgagtgtatttcacatacaatttaatttctaaacatggtggcattctccgtaataagatcaggaaaccaagggcaaacccacaacacgtcagctatatatcactaggctaagtcccttacctctccacaacacaacttcagctttaagacagctaaaactaaatacaaagaaacagag

SEQ ID NO: 5130 - DNA, 1538 bp, Arabidopsis thaliana
tttagggctctgcatcttcataacaaaaattggatttttggggaagctttattcaattccaagaaaaaggagacagcttttgaaactagcgacacagagaagcaaaaacccacctcccaagaagaaaaagctttaacaacaaaaccaaacagatactaaaatctcttgctctgctcgctactgttcaatagagagagaaagagtaaaagaaaaacagaggaaagacgaagaggcgagtgtgaagagatttaaaggcagttgtcaggtttctgacaaatgcgtcagcgtttttcagccttatttgaatacttttcggacaataaaaaaagttgagtttccctctttaaacaatgccacagagagactgttaactcctctgtccagctgctccactatacatcattacatctccacgttcttattcctctatatgggcccatcttatcataaaaggcccattactactactccattaagttgggctctactcttcttctttttttttttttttttgctttaatgattcaaaatttgttgcttctcattggcctttacttataacatttctctttcacctgatgccttttcatcttggtcacatttttgtatttctaaaatctatatttttcagtaggcaggaaaataaaaacagagcaaaatactttatttttatttatagtatataaggaaagtttgatcatgtaatgcttgtatcatatactcactcactagtggttttttaaatattgtccacacgtgtaaagtaatgctttaacagctctaaaaattcctataatgggaagcagtgattcaatattggtcctcaccgaattgtggataattctatttatatgtagaacatgaacgtcggcaaccgaaataaatatatagaatttgaatcatacatattatactgtagatgattacataatatcaatacttttatatttatatgtattggtctttatatattgttttctactatacgaaatgtcaggtttgaatcattgttgagtaagatacatattgtattggtcactacaccaatccacaaacaatttatggtatataaaacattttcgataacaaaatagatagcattactgaatacactgaccaccacatataaaactcgacactattgatcaatttagatgaagaaaacgagaaacaatctccagtgttttatttaggccaaacaaatatctaagagtaaaaagaagcccaaatctctaattttttggtgtaatataaacaacaagacaattaaatggaatggcctcttttcttcttccagctatgtccgaaaaagaacacatggccccaatccaacccaactcacttcttataaacaacacacatttcaaaaatataaaggcaaaattaactctagtcaaatactctaacctaaccatgatcaaaatttaaccgtggttaacaatcatccttctcttttaacttcatctctcttctcactcagtcttctccacttcctctgctccacactgacacttgaaaaaactcaaaaccgtctcatc

SEQ ID NO: 5131 - DNA, 2000 bp, Arabidopsis thaliana
tttttccaaacattttagtaaatattatggatcacacaaatttttaccaaacttacaagaaataccccgcagattaaaaccttgtttattttaatactttttagcttaaatatccccattcagaacccactagaaatggtctaaggatataaaatttactcaaaatccactcgtggaatatacaaacaaacaaagaaaacgaaaataaccaatcatcgtttttcacttcatctaactcaaataaccataacctagtgttttagtcgagtgggcggactgagttctttcgtgactatatatgcttcaattttttaagttttgttttgccattggaccatctctctaggtttataaacataatcgttttgtttttaatgaaatatttatattcttaaccaaaaagggaaaccaaaatcaccgaagaaatttcgacttcatatatgttctctcttgatattaggagacttcaggaatttaaatgaatggcaacgcgataaaatataccgacttactacaccggtgcttgagagtcgaacctaacccgaccaaaatctgggatgaaggagcaaaaataaccaagtacttgaccatatcttgttgttgcttcgagtgaaggagactgcatgatagtccccttatacaaaacatctcacttgattcactcacaaagtgatgtgtcctcttctatcgtttttagtctttgttttaggattatatattgagtcaactaacttatattagataggttttagttctttctgctacacttcgtggttttacaggtctaaaaagtgcctaatttgaaaaaagagattttggatcgtcctggcatgaaaatgagtcaagtatgaaaaaatgaggccaggaccggtcgattccctcaaagaatcagtcggtccccttagagacccgagagtctgatctctcaaatgtgccaggaccgatcggtcctgccctagaccgatcggtcccctgaagatagtggctctagatcgtgaagaatgttccagggaccgaccggtcctcacccgagactgatcagtccctccctgccgactcaagactttccttttctctcattatttacatttttatgatttccctttctctataaaacgatgagactcaaccttgtaaacctagacacgatttttagcagtagcttttctttagttttgtaagcttagagatctcatatctcaaaaacttttttgaagctttcttcttaatttgattcttgaataaagatgtcttcttctatgttgttctttgttcttgattctatgtctgagtagtttgcttactaggtataggatttctaagggatgtgattgattcgttaggttgttagatttgggagttcatcttgttggttcttattctatgttgttcttaatgctacgacttgagtagctaactagttctatgattttaagttgattaatcttgtgaacatatcaatcttgttggttaatgcttgctttgctttattagagtcaaacaatggtttaggttctgatttagtattgcttagttaggttccgtcgcaatagcgaattatctatactttcgtgaattgagttcaaggatggttcttaaatattctcactaatcgattgaattgtcatctcacatccttgatgaatatcctatgcctaatgcttgtttaattatttgaattgtttgcttaatttattcgcttgatagtttaattagaaaaccaaataaaaactttaattgattttatcttagctttatttattctaaatgtcttaaagtgtatccttggtctctgtggattcgatcctaaagtactacaattgattaccgaattgatccggtagtttgcatatttaggtttttaattgacctcaaatcaatttggcgccgttgccggggaccaaacgattgcctctaggatttttagaattgaatttagtccaggatttttatttttcgtattttactaattatttttattttttctatcttatctttag

SEQ ID NO: 5132 - DNA, 622 bp, Arabidopsis thaliana
gatgagtctcttccaaaaacattggcatctttatcattttgctacaagacagtaatctaatgcatcaagtattcaacaccaacaacacttaaatccaatttactttgaaaagcagaaaaaaatctcaactttgaatcacacacaacagaattattggtaatggaaagtacccagaactagtgttgaggaggtgaggacgaaaagttcggcgaggagcgacatggaagaagcttcctcctccgtcctctgtgttcgatacaggacaatgccctgcaagtatttgttcaaattcaatttatcaaaagttcagaatcaaattgaaaaggtgaaattcagagagagagagagattacggagaagcgccatggaagagaagaacccggggacggccatgagcaatccggggaccaaaaagctgaggaggagaccctcaaggcgaagccgaagtagcaaatactatctctttgggattttgcttaatggtgatgacgtgttctttccggctacgccaaaaaaatctttgaaacgatgcgtttttgtcaaagtaaccaacacttctgacgttgcaaaatcatcatatcataatccaaaaattgaaatagaaaagaaaaaagggaggttt

SEQ ID NO: 5133 - DNA, 421 bp, Arabidopsis thaliana
tcacttctttgtttgctttctattacttaaaagttaagtactttgcttcagtttcaagacccttttgcgtgattgtaagagtatgagattatcgacacgttgcttattataacgtttttatctcatatctttggtctatttcttaaatatttatctcaaaaattattcacagaataacatcatgagtccctcgtaaaacatcattcgtctctcgtaaatgtgacatatgttctaaatcaacacaagaagttgagtactctctctattgaaatattcaagtagtttggttctcttctgatagaagaaaaaagaaagaaaaagaagcaaacttgtaaaacccaaaaatctctgttaagccactaaaaccctaaaggcgtctccttttctcgccaccactctccacaatacccatttctgcaaa

SEQ ID NO: 5134 - DNA, 716 bp, Arabidopsis thaliana
attttggagcttcttcaaaatcacagtttttggtagttttttgttattgtattggtagagagaatcaatcatgttagggaggagagagagatgaaattcgctcaggttattattagcctgcgagtttgagctgttttttttatcaattgttgtagtttgagaagaagagtatttgattttttgttcgttattggggatgaaaacgggaaattctctttgtctgtttcagagttgtggctgtaatgtaaaagagtgtaaactcataagttttgtttgaaatgaaaagttctcagaacagagcaaaatcttcagcttccaactaaatttgcatcaaccataatgatcatctacgaaagtagctaaatagagaaagaaagaaagcatctttgagaaaacgtatattcggagatgtctctgttatgaaaaaaaaagaaagagaaagagaaagcaaaaaggtccacttgaggtattggttgaattgaatattatttttgtgtgcagacgggcttcacgtagccataccagcacaccagtgagcattttaatttagacaacaaaagacttaacctttgggagatctcaaaaggttctcttatttgcagtatcgccccttaaatcctttttcgatgtttcttatgttcatcattattttttaactaaaaatctcatctttagacaacaattcaatttgccatctctctgttgtatctttgacg

SEQ ID NO: 5135 - DNA, 2000 bp, Arabidopsis thaliana
gttagtgtaggaagtttgtccggatatgcaattttttttttgtaacgtgtatcatctcgttaagaactcatatgtattatatgaacaaaatcaatcatgtatattaaaaatggtttgccctaaagatattctatgtttttttcgtgaataggtgttaaggatattaaacaaaaatacccttatttattcttacgactatcttgtgtctatagcactctagcttctacgttggtatcatttatattttaaaaagattttgtgatattattatttactggtataaattttaaaatttctcacgtttaataaaactaaacatattaataatttaaaattattttacttttgatttttattgatatggttgacgaaaaagagtgattagtaatggaagtttgtctggatatgcatttttttttcttcgtaacgtgtatctcgttataagaactcatatgtattatatgagccaaatcaaatcgtgtgtattaaaattggttgccctaagaaaattcaatgtttctttcgtgaaagaaagtctattttttttatagatttgattctcttcttgggatttccacattaaaattattatcttagaggctcagtttgatacatacactatattttttatatattgttcaacgtatagtgactgaatggtagttgtttaaaaggattgtgtaaacgagttggatagccaaaactatgttaacttgatccttgtaaagtaaacaaagccatgcatcctctaattcaacaatttggtcccattaccccaagaaaatgttataaagaggttatctttatcaattacttgtaaacaggacattatctttataaagaaaatgatatacatgctgcatttttttggtttggtagttttacatgctgcattttgtacttgcaaccacttctatactaattgttttagataagatagtaccttcttgtttgatcacatcgtaaaaggatcggatatgttaaccgtctttttccaaacgttatatactcttcaacactcatcataatgtatggagatgtatcaagtatctcttacgaccattggtctttgcggcctaatttgcaacagaaagtcagaaatatccatactataactatgctatttgaaaattattcattttgactcatatataaagtagagttaattaggtgtatagccaaattatggatgaaaattagacaaatgatcatgacattcttttttcttaatttcccaaaagaattgtaatatcagaagggaaaaatacattccacacatagttagaacttagaagaggtccaatcaataggcggtaaaaattaatttgtaacggtaaacaaaaacgataaaggataatagtacaaactaattggcaattaatactgtttttggtcaaatatatatgtcacgacagtagatgaaaataccgtttttggttgaatcgttttattttttactttgtcttgaatcttgtctactcttcaataccgtttttcgttgaatcattcaaaaaaaaacagatctcctagtgatatgaatcaaagtttatcaataaaaatcttagtatacatttgcaaaccataacttcataattttgaataaacgataatgtaagacaggttggctcattagaaagcatatcaaattaattgtaaggacacaaatatctataattaatgcaggcttttatgaatcaatcatcatcattcacatcctcgtataattgtctaatttcgtacctcaaaaaaaaaacaacaacgtgaaaacctaaaattagatgagttacgaaaattaggcaaaaataaataaactaaatcatagtattacaaaacaaaatgaaaacgaaaaaatgaagaaaaagcaagctggtccccaacagacatgcgagttcgtctcctataaaactttgttaatctctccttcacacttatcacgccacctcaccacctctctcctctctcctctctctcccccctggagagattattcattccctcca

SEQ ID NO: 5136 - DNA, 1737 bp, Arabidopsis thaliana
aaatctgaactaaccgaaattaattctccgattttaaaagcttttttttcttccttaaaatcgttataaattattaataatttattatgatgcgaaggatggttacgtaacaccgcaattcaagaaaaaagataaaacgaatttcgtgaatatgaattttatatatgggatataaattccacactgaaaattgcactattgggaaagaatggattgcagaaataattaaaagtactatatatgttttcttatctaaactctctaggacaataagaaaggaaagaccaatatcatatgatttggacttataactacaattgatcttatccgcaaatgtcgatatgatcatcgtttggtatattgtaatttagttgattgcaattcaattaattgcaagttaactctcaacattctccatctttgtaactaatctctgagtatttgtataattctttctaaatatagtacaattttttaagatgcaaatttatctatctagagcagcagttaccaagttgtaggagtagcggttgaagataaggtcatcattttttttatttattttttttatctgttacctttctgacgaggcagatgatatctgtgacaaaacccaagtagtaaaaaacatagtattcttatccattatttataaagtttctgaaaagacggcaccgttttctgttggacgaatcatttgtgagcagcagcagcaagagagtttaagggaaagagatcatagacactcaagacagtagcatgaatgtttaatattcttgtctggtccgatgattagaaatactgttaataatggattggaggttactagtgtattagtgatctaacttggcatgaggattatctcattgtcttcttaattaagcttaagagttaagaccaagcaaacatttcacgggagatgtcttatgtctagttggcttagtactagtgatagtgatgtatcgtctattgtatcgggctatacgttttattttgggtttgggctttttattattttgggctttcttatatgttctgaagttattttgttttaatcacctgactatgaacgagaacactgaacacagcttaatatcgcaaagagtggaatttggcgatgatacaaaacattttcttcactattcaggagaaagtctacgaactcattgactcggaaagttgtacaaggatggttttaaggaatatgtattgatgctctcatagtctcatgctcataccatttataagtaagcaaaccaccgttgaacagaaaataagaatttggtatgttgcgacagaactcatgtgctctcacttgtttagtgcgttttaaatatatctaaaaattgaatacaaaatgaagtttttgttgcaattaggtgttttttattttatttttaatctttatttttcttataaaatagggtttaagaaattatatccatacattatttttgttaagaaaataattatgtaataatgtaagagtattggtatccataaagtttcttagattttcaacaaaagaaaaagcaaaaaaagccaacaaaaaatgctccaggggaaaatttgaattgcaaatacaaacatttttcattacagcttgcactatcgcggtcgctttatcagtcatcatctcttcaaaagcttccatttttctaacttctctcaattcccaaacaaaattcaaattcaaaaaacttctctttttgactaagagcgagattttagggttcc

SEQ ID NO: 5137 - DNA, 2000 bp, Arabidopsis thaliana
tgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatgaggatcgattacacagaacggatgcctcaatcctataaggtttgttgttttatcaaatatgtcttatgatggagttttggtgtcttaaggtttgttactgtaatgactgacatgttgtgttgttctgtttcagatgcactcttccattgtgcttagaattgaagaggctagttgatagaatcatgagaatctttcctgatatagaag

SEQ ID NO: 5138 - DNA, 1463 bp, Arabidopsis thaliana
cacggaggggaggcaagaaggaaatagaaaccagacggatacgggtttaagaaatcagatgtccgagaagtgaggagagagaaggagttatgtgtttttaataagggaaaaatgagagacaacgaacaaaaaaacagagaaaaatgaggaggtggaggaagacgagagacaacttggaaaaagctaggcgacaacaaatttctctgtgctaaggaaggagagaggatgtgagtaaaatgaggaagcctcatgaaaacttaaccataattagcaaatctcctattccaagtaacttttgccaagccgaatctcttgtttttcgtaaattccatatgtattctcttccatatacacaatcttttgagagagaaaaacaaaatccaacctcacttttgttgacaacagaatccagcataaaacattgttgggaaacttgttactcaacatacttttgcacctggttgttgttgtagttgatgtatccggagaaaagaagataagattcgggtcaatacttaatctcaattctgtctgcagcagttacttaaacggtgtcctttaattgttaactggataactatattttttatgatcttatgatgggatttgtttcaaactttcaattaaggtcaactatatatcaatcaagtggcactggtcaggacctgatcattgattctttcagttatcttttaactttgagaaatatggaatctcataatcctcaagcaatttcagattttaggattcgacaaatattgctaatcaaattgagttctatgaaaacaactataacagaagattatgaagaaatacagttattacaacttacgaccatgaaacttgtacaaataatggattcaccagaaaccaatccaaatatcttatataacctcaaagcttattctatcgattctagatagcaaactcgttcatatatccatcaacaggcaaaaaacacaaagactctaatagaggatattttaaataactgtttgcattttaactgggtatatacggtttaataaccgggttatagatttaattgtctaacagttagagttgccacaaaggattctcagatacttcgagaccaaaaattaaactgagagatgttgggacccacagtaaagtgggaaccctccaaaaataggcgtatgccacttagcgtggagagcacacggtattctttagtaaaaggcgaaagaatagttcgctatgtgctcaccacatggctgcgtggttcgagaatatggagagtgaagtctatatatactaaagtttcccttggcaaactctctcacctttccgatgtgggactctccaaatagtgataagacgcgtctgatttaatttaaaactctgcttgggcttttatgggcctaatatactttgaacttgggctaaaaaacgaaatcgtttcttcttccattttttaagcctactgaaaccctacaagaaga

SEQ ID NO: 5139 - DNA, 1905 bp, Arabidopsis thaliana
ggaaattgaacacaaaatctgctttttcttcacctcaaaaactgggtctggttataaattctaatcacaatcactgaacttcgaatcaacttcaaaaatcgattcaaaacaatctactcgatttaggatgattttgaaccaattaaattgaaagtttctcagtttcgtctgaatttttcttagtcgtattaaagtcttggtttttctggaaagaagaggaagaaactgaatgacgtggggagaaggaacatgacacgtgtcgcaaagtaagatacttttgttaaacatgttgggcttcataaaatatttgtttaagcccagtagggaaaatatgttgaactttttttggtttttacatggaacgattcgatattctgtgaggcccaaccagaaagaatccaaaaccgaatcttttttgtttctctgggaccttaaaccgaattttaacgttttgcgtatgattctctagacttgtaattctagttgacagtcaccaaaaaaacactgctcgatggtcacatccatacgacacagtttttttggttgtggttaaccccacagctcaataatgatcattttttcccatttgacatattagatacttatgaaaaaagaaaaatatcaaaagtggtaatttgttattcaacttgtttttgtgacagaataatgaaaacaaaaaagaaaataataaatacacagaataatgagtgactgattttgagtgaaaacaaaaaagaaagaaagaagaatgagtgatataaattcatttctttatcctaagaaaataataaatttgtttgccaaaaacagacaaaataaaataaggaattcactgaaagaaattgcctaattttcaggacacgcgtcatataacaatttgttagtcggatacttttttggtacatcactgtcgtctctttttcttttcgttcaattaaaaggtacactaactatttttttaagaaagatattaaaatcttgaaaaaccatggccgtcagatccattaacctttcaaattcaacggacacgattcatcgtacgattgacgatgaacaataaccgaggaaaaagtgacgtcagcgtcttcttcctcctccaacgtcccataaagaagcgccacacacacagtcacacgaaaactctactgtaactgcaaaatcttgttgttttcttaaacgaagagagaagaaagaaagaaaaaaacgttacggattctctgcttcggtttcgcgattgaagcttgagatttcatctgtaagatcatcttcttcttcttctctcgtttctttttttccttcgaaatccgtcgattaggtcatttttagtttatcttctcctgttaatggtacttgttttgatcacttcttgttgaatcgaagcgatttcgtttgattttgctattttcttgttggtttcgtttcgttttgagcgccgagtacttggattggtcttcacagatgatcgattcgtcgattatctttcatttgtttggattagttctgtttttcgattctatttcagtttccaattgatgtagcttagactagttggtgatttgagtgttttgatgtgtatttacatgaaatcgatgatggatctatgttcttcgcatatctctgatactttagcctttcgcgttgttagatatttgcctaagatgatattgagttgcattagaacagtgaaccatcgtagaaatgtgtgcttcatttctctgctcggatttgaacagtcattttttatggtttataagattggattctgctggaatgttgaaggatttgtctggtggttattgtatgaaatggttaagtagtgagaataatttatatggcctgttttgagtttggtatatgattgaatgagactctccttttgtttgcatattatagtgaacatccgat

SEQ ID NO: 5140 - DNA, 1344 bp, Arabidopsis thaliana
tatcgatttctttcgaagaattagatgctcaattcgaggaattgattgcaatttcaaatcacaatctgaaattcaaaaccctagaaacagtgaggaagatgaaaaacccccaaaatcaaaaggggttttgaaaataatattaaataaataaatgggcgggagttacgcttaaacgaaattaaagaaacgaaattacgaaaatatccataaagttgaatacggcccatgggctcaataatattatgatcaccaaataacatttctaaataaagcccgaattgtgatatttttttaaaaatagttatgtttctaataaattcgatgtatttaaaagttgtggtgacaaaagatcggaaaaagaaaaagaatgttctttctttcacggtgtccacaaggctgacaagcatgattaagacgaccactaaagttttcttgacaccaacattgtacttactttagatgctcttcacgagtttgcttcaaatgtaataaaaaaacttcttttagttacatgaatcgagatcttattactgaactaattatgggagaatattccccatttttctaatattaatggcgaggtatcaatctacatctatagccaatttagccacgtgtgtgggccaacttttatccgttgaataagtgcttcaacgtataattaaagacttttgaaactcttatatggacatataattaaatgacttggcctcaacgtatacatcatagttttatatctcatctctaccttccatagaaactcatttgaaacttttgggcagagagtctgaacaatcgctttgttgtcgtcaagaacgatacgtccctataaatgtaagttattttgtttctctaaattcagaaatatcccacctaaaaattcgactgtttggtatttttagtaacaagcttcatgaataatattggagattttcttggataaattattgattttcatctaagttattccaagtttatgaatttcccactcatcatatttagaagaactttgattttttttcttgggtggcttttgggtcaaaacaaaagaatgataaagtctcattattattttgagcttttgttcatgtactgtgtggtcaaagacagtaacataaagtctttgttggctttgagttttagcgtatacgcgtaagactggttttaacattttcaatagttgactaatctctattttcaattttgttttcgggaaagttcgaggattcttcaaaatttattgtttatatgaatctgtttctgtttaaacgttgaacatcattttctttttgtgtttatcctctgtgattaatctctttgtttgtttctctatcaatagtagca

SEQ ID NO: 5141 - DNA, 2000 bp, Arabidopsis thaliana
agtactatcaacattccacacttgccttattctctctatatatggtgtacttaagtatatatatcaactaacacacgttgtgtaatatgtctaattttgtgtttatatgacttcaataacactacaagttaacgaaggactcaattcgtcctactccgaccacaatagttgggacccaaattagttgaaacaatatatttcatctttatcaaagtaatttttaaattccatgtagaagttattcacaaccaataataaaccacattatatgttacaaattttaacatttttatacgtatttgcgattacatgtaggttatctacaatttttggttatctatgatttctataatgtaattaggttattgatccttttttttttactgtgtcttagtcttactggatgtgaatactatagcagaattaattttaatttaaaacattttaaattgatttttggtattggaatattgtaatatagcgttgacggggacagtgaactaagcacatacgtgtgcatttttctttaaagaaatatcaatattgtgcaacgatcgaaccggattaataccacaatgttcttttacctcaaacagtagtgaattaatgttggacatgaatttagaaatcccgtttcaatagcatttgaataagctaagtagtgatcttacactaacatatattaataagctaagcactttaatatttcaggtttgatccgactttttcttgcactaacgatactgccttaattcaatctttgtttacgtatgcacatcaaaattatttaaaaaaaacattcagatgttcgacagaaaaaaaaaccccaaaagaaaaaactaaaggaggcatgatatttaccaaatgccaaacacaattgaatatccttcaaaacaagacttttcgatttcgtgtcctccaaataaaaatcaaagacttttctttagtttataaaccccaaaaagagatcaacaacgaattttcttacggccataaatgcttctacattaacaaacaaacaagatctctatgcttatattcattgactattcacatttttatataattgaaagaaataaactttatgccaaaaacagctctatcattatctcatggggtgattttgataataataaaataataaaacattccaccaaacccaatctttgtaaaactatgaaacagctgttctgttctgattcgtacttgcttcatcaacctttttgtaatcaaaagctaaatcgtataatcacaaatccctcagaaactgttcgttttttgttatcgtttacgcgtttttaatcgctaatcagttatataaaaaatcgacgaaaggtttgacgaatcgtcgtcgtcgtaaatccccaccgggtcaatcgactcgtttacttttctacggtcttctctcctcaaagagtctctctctctctctctgatatttccgcagcaataatggtatagatagagatacagaagcagacaaattattgctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagag

SEQ ID NO: 5142 - DNA, 1572 bp, Arabidopsis thaliana
tgaaaaatactcgaaatctcgcagagggaaatgttccctctccaattgcttcaaatcaatgctttttcaattaccattgaatccgttttagccaaagccattcccggaaatcgccgttgttatgattgaggagaaaactcaaatttcaaaaagcccagatcctgacgcacagatcgagaagatatcgttgaaatttcggggtggaggaaacagatggagatctcgagaaaacaagttcaaaaatcgatggaattgtcaaacaaagaaatcgaaattagggttttcgatctgaaggagaggaggacgaagttcaaatattaattttgttcgtcagatctctttttaacagatccctttctttttattttccccttctctgctttgaattaaacgtttttactcgtttttttttttctttgtttggttgcaatttttttttaacgttcactcattgtttgtttggtgaaatttagatttcatgtagcttttgattttaaaaatgtataagaagtgtgtaatgtatttgttcatagtctgttgtattttttgaaaaataagagagaatgtttaggtagtaagaaaattaagagaaaaaaaaatggagagaaatgagtcgtgatggacacatatgacaggtaaagaaaataaataggagcatccatgtggcccgtggaacatgacgacagcccaccaaattactcatgtttttaaagagagaaattgacaaattttaatatcaatagaagcttcaaattcctctactttaggacaactaaaagagcaaagtaatgaagaaaaaaagtgaagcaaggtcaaccttttggtatcatctaggtgtttattatggggtttggttcacttttttgtttgcattgtttggattttggatttcttttggagttctatttcatattatcagtttttatctttgcgtatttaagaaacttttactgaggtaaaatattacacaaattgccactgattttagagaacaaattcaatttaaaaaactcgaaacaccgatttgttttgtagagctgaagcaaacctaaaccaaaaacctaatccaaccggaaccatttaattaccgttggttttctttggtttggtgtggttcagtttgattagattcaaggatatttagatcaagcgatataattttattttattttttggttaaacgctatataaaatttgacatgtatattatggcaaaatcacaaatgctggttatcaaaagatgaaaaaatgaaatctgtttctttggggcaaaaaatattacagaaattaaattggaaaatgagattaacgacttttttttttttttttttcgtcaaatgagattaacgatttttaagtttgaaatgaaagttaaaccctaaagaggcctaaaaccctaaaaggctcatatagtaactagcagctgcttctagactcttctccttcgcttattaagccctctcaactcttcttctctctctctctctctctccgcctgttctccattgatctaatctaactcgctcatcagaatcatctcttcatcgttaatcctcttccttctcactcacc

SEQ ID NO: 5143 - DNA, 457 bp, Arabidopsis thaliana
aacaattcctcctaactctttcttctgttttagaaaaccctgtctcagttttgtttacttgtctgaatcttaatctttgtactttatatgcattattggctttagtttcagttatttaagtatctaatttcgtgtgaggataagcaagataagaaaattttggcgggtagttgaagcgtgtggagacatataaatccactagctgacacgtgccacggacggctaagcacgctttcgccgatcgccgatcgccgctagattcatctcggattcctccaaataagcttccctggttcttatcttgccacgtcagcatttctccctcgtacgccttaaattcttcacaaaaataataaaaatattaattcaaataaatgttcatcttctcctacgaatgaaattgaaattaatttgagcgatcggaacaggatcgggtcggatcttttgaagttcttca

SEQ ID NO: 5144 - DNA, 777 bp, Arabidopsis thaliana
ttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggttt

SEQ ID NO: 5145 - DNA, 2000 bp, Arabidopsis thaliana
attaagcgtgacatgtgaaacattttcccttagattctggtccttgttaactgcataaatgttcatgttctttgttttgccgctttggttggattccactaaagtctaatcatccaaaatctttggagtgtattaatacatgacatattcggccaattcaagaaaacctgggaaaacagttaaaaataaattatttacataccgaaaatcgtaaacatggtaggtaaaaaacaatcaaattacttaaaatatttcttaaaattttaattgatttaagattttaaaattattttttcatagattaatagtaattttcaaattaccacatatattccatgttccaaaactataccaaaatcataaaattcaagatattcagatttgtgaacttctctcaaactttagtttgcgatattttgagaaaccatttcacaattgtgagatttttaagcaattttgttttttgggtgataatatctcaaggttttttttttcttctttagatttggtaaaagaacttttgcacacaaacaaaaaaaaagatttggtaaaagaacttttgatatttgtctattactgttggtggacaaaaccgttttgcaaagtatacaagaaatcttggtgtattaatttttcatcggattgatataattagggcttaattagatccaagcatgtactttgtgaagttaaattcgggcaatgaaacaaccacacaatattatcataaaccactatggaaagaaattctttaagattggttaagtacttaagtttaatatgaacatttgtttagtcttcttttagttctcaaatctcttaatttacatgactgattctttggaatgtatagactatgaaattatgtttatatatttgctaggtattagcatctctggtttggcatgacactactatatatcctaaactatatatattatgagaaaaagttagaattcaaagatttaattttaataattacctattttttgtcatgacaattattgtattttctaatatttttctatctatattccccaaaaaaataacatttgaaatcccagtgaatctccatgaataggagaaaaatattgagtcaaaacaccatcaaatttgtttctaattattgtctgtaatttcctaccaattaaagataaatctcataaacagaagaatctataatagtgctgtctataatctactacctaattgagatgaatctcctaaaccgggataaaaccggtttataatagtgctgtctataatctactacttaattaagatgaatctcctaaaccgggataaaaccggttcaataaccctgataaaaagaagagggcggctgctaacgtgcgcatcgggtatttatgagtagaatcctcctcattcctcatcacaaatacaacaacaaaaaattgtgtgtggactctttctctcttctttgctggttttgaggagaatcgtgtcggctaaatttgtgtcagacacaccacactctgagtaatttttctcatttcttcgatctctctctctctctcactctgtttttctcaatttaataatctcttctcttctctttcttcttcgttatatatataaattaacaaactttcttcttctctggcaatttcagttgcaaagtcttcctcttcttcttccaccagagacaattccatcatcatcatcaaatagacaagggaagaattcaatttcccctttctttattggcgcgaagatctttcacagaatcaatcaccaacgaaaaatcgagaatgggttcgttacttttctctctgttttccgatgattgaatccaaatttgtatcttatgatttgttttcgtaactgggttttgttcaattttgagtcttttgttgttttgatcgttttagggtttactctctgtttttttcccaaaaggggtcttcgttgttattgaatctaatggaattggttttttttttttgtggacagatgtttgcttgagctattcatataat

SEQ ID NO: 5146 - DNA, 1814 bp, Arabidopsis thaliana
cttaacggtatcggcacaaatgtttttcatggaggagtaattaacgtatagcagtttcatttgttgtccattatgtttcagagcacaatgtcatagaattgctaactaccatgggagaataataattgtctaattaagaggactaaagatgcaaaaaaaaagatgaaattattggattcattcaaatacagaatgaatatattgcagttgtattggctacacctaaacagagaatatatcgactgtttgggacaatgatttcggtaaaccggtttagttttcggttgactttgagtcaaatgacaatgaacagaaaatagtgattgaaccggtatgtggtctgtctgaggtctgacttctgaggatctcgtctattccctcacgtaccacatttgtttcctcctatcacctttccacaagatttaatttctcacctattagcacttctctgttttgctgctaatttaagtattacgacgccgtttctatatcaagcacttgactttatccaaaaaaaagtctcacaaatacgattgaagagcaaaacagcgaaacacttttcaacaccggttggttgttgacgtacttcattcttgcgctgaatctcctccgattatatttgataaatctctcattggacttcgtctacctttttcttacatgatttcctatttgaatttgtttacacagctcagttttggggtttaattgatcaattaagagtttatcggtctagttttatgggtgtttctgatccatttctagcacttgaaagatctgttatccattcaagtggtaacaaactgaattatctatatttatataataatcatttaaaagatttgttatcaattttttttaatttaattatttggatttactgatttctcaattaatattagatatgcataccctaccacgtacatgtgggcatcagctagagatttaagcaaatcttctgtctaatccttgacgtggcaacataatattattttacgtaactgagagtttctaccgatccgtattaatttaattaatttactgtaattcacaaccacataacaaacgattaagaattgaaaacttcatatgtttaaaaactgttactcaaacatttttcataatttcttactcattgtccattattgtttcgggtcgatcgagaatctttagaaaaacgtgaaaatcttgtcctcttaaatatttctgtcacatctgttttttttttttgtgggtacaaagtcacatctaagtttcttctgacatcgtcgccttttgttctacagacggacaaacgaagtacttgtgctattaagaaccaactgtttacttccataacgttactactagttagatagagaaaatgagagaatattgatacaacgtgcgttcgacttaggtcaagttaaataggtgagtccacagcactagcatttcaggtaggatttggcatcttgcctcaaagtatataacaaacaaataatacaaaattacacacatattgacatattatgtgataataatatatttgggaaattttcaaaatagactgttttcttaaaacttaattaggaatttgggcagtttcaatatttaaattagaaaataggcatgttttactgtgcaacactatgtagaagattttctaactctcaaaatctttgtttatttactatttgtgccattgaattttttttttctaatgtttccacttacttttttttctttctctctcccccttatctcttccatcgattattttcagcctctttcctctatttttttgttgaaatcctctaaatgatcttgcagag

SEQ ID NO: 5147 - DNA, 2000 bp, Arabidopsis thaliana
tttgtatttaattgctctgcatatacttaaatctctgcttttcatttggggtattttttagtttctcgtgctgtaattaataacttgtggtgtactcaaataagaatatttctctctgttttattatttttaaattggagaataaacttctttgttttcatcgctgccttatatatattgcttctgatttgggttgaccatccatccagtttgcaggatccgatagcagtaaatatgtccactatgaatgtggtgcatggacagtcatctcttacagacttttgcatgtaaaattatatgttgcatgcatgatggtatgtaatgaatggattggatgatgtcatgactcatgatgattaaaaaatacgtgagtccatatatttctccaatagtattaaaatacgagtacatcaaacatgttttccaacactgccacaaaatgtattggacctatatcaataagtgggccttgatttcccagcttatgatggcttaggtttcattgtaaatggtgaaacaggccttcctagtgaggatgcaggtcatcaatagcaaggtttaccaacggaggtttaatcctcatgaagtgatgaagaagatgtcgaagagttggagtttgagaagagatgtttggaaaggtattctaagaaggatgcagaggatgataatgagattgatgatgttaacgacgttgatcaacaagcgcttttgccatcagtccgtacgtgaccctaaactgtggctggtgaaatgtggcgttatgagtttttgttctctatgaattccaagtattaaggatatctcaacagacaggacaaaagtttaaggttaatgatcttttatcaaattcaatcaataatcagtctccgaaatcttagtgtatacaaatggcgaaaaaaatataaacatcattttccaagtacacgaataatgccaagagtggtaaatgatatccatcaagcctcttatcttctcaagaaaaaggttgatgcctttgtttttgaagttttctgcatattgatgtggtccagcacaaaccattgttatccactttatcttttatttttctttaaccccaacgttttctactttagcacttctacttatctctagtaattctccatttatcacttctacttattgtccacttgattcttgagcttcatattgttgaattcgtttctacttttctgccatcttctctttatatgcttaaattgtatatttttacgcttgctgtatagttttttaatgattatctttagtcctaataattggggatttaattgatttttttcctttgtataaaaatatacagtaaagatattaatacaatttcattgtctctaaagttttaagataactatgtagaaaataaagatgtagacatatcatactataattaatgtcattactcattatctttaaacgtaaaccgacacaaccaatcaaaacctcgctttccacataatcacgagaataagccacactaatcgactttttccatggaaaataatgaaatctaccaaaaatgaatgaatggtaacaaaatccaaaaataaggagtgattgggtcagtgaaaacgacaagtggaccataaagatatccatctgattaagaagctgaccaatcacaacattaagaataggatcaacttgaagaactcgaccaatcagaatcgagataagatctcttcatggccctcatggggtataagcaaccaaaaaggtgcatcaaattttcactttaaattatacaagaagaaaaaagctcacatcgtgtgggacatgtactagccaacaacgcctctacacttaacccttcaatgcctcataaaatgaaaatgtagtctctctttttataaccacttctcgaaaactgaaacctttgtagagagaacccatagttcgataaaacattctttttgcaactgagacttggcaacttggttttactcaaagtaagatttcttcttgttgatggtgataagttcaatatg

SEQ ID NO: 5148 - DNA, 2000 bp, Arabidopsis thaliana
tttagaagatttaaatcgttaattaaatattttcatttctaaataattaatgccagtagcatgacattgtaaataagttcaaatacagaatttatttatttaaacaaaaaacgtttagtaagaataatatttatttaaacaaaaaactttgttttaaaatattgttaacaaatacgtttatgctaattttaagggattgatgtgaagtttgtttggattaaatttgattgataatgtgattgacaatttaaattaagaatttaaagtaaaattaattattttgaaaaaaatatttaatgctaatggcattgggttgtaaataagtccaactctaagatttatttgttaaaataactacaaaaatatatatatagatatataatatataaagttttctattcattgtcaattgtttttgagttagaatctcactatttaatagtatgtggggcattcgtttacagcattttactcagtcaaatgggttctattggctctgtagggcaacactgtcttttcataaatatatgtattttctgtttttccatatacttttttttattaacaaaatagacttttcatgtgatataaaaagactttatcttcttaagatcatcttacaccatccacattgcacatttatattggatgtcttcctccacaataaactattaaaagaactaaaatataattattaaaatatgaaaatgtctttaaataaaaattctccttcccataatgtcttttcatagacattttaactgaatgtctctcatttaaagacactatcatattttaataattatattttgattttcttaatattttttttttttgggggcaaacgaaattttcttaatattttataatagagaaagacacccaattaaattgtccattgaggatgctctaaagagtcctctagtgaaggtgctcttatgactccattagtcatacactaaccgtatgcaaagaaaacctatcacttggtggtagaatataattaagtattattaacccaaagcacaccaaaaaaaaaatgtaattaaaatctgtaactaaaatgaattagtcagtcaaaaatatcataactacgaaataaatgtacactaaacactatcaaacgtcccttagtttagattttggttaataaagctatgcgtttacaggcttctaagttttaataatgttggtgcaaacgtggttgaactaattctgaaaacaatttttagcctaaatggatctaacatgaaaatctacatttttctgtttatatgtatcctaattctgtttagaaagggcttcaaacttttggcccaaaactttatatgcatgtatgatatatcaattaattttaccgatggagacttgcatgttatacccattacaggaaaaaattagatagcctaacaaacaagtcatggcgttactcgtgtaaggtggagattttacgttgattttttcaaccaataacaacaacctccggaaaaattatcacaaaaagaaaaaagaccaattcaaacattcaacgacccaaaaaaaacaaaaacactttcaaccaatttagttgattctgccgccttcaaccatttttgttgcatggttctttttccaactttgcatttaaccggtcctttaccaccggtcaatcacaatttctagtcatccaagactaaatcgggcctaatctattgcaccaagccaccaatcaactttaattatccataaaacgacactatctattggcagaagcttcattagtctttttcttcgtgagaccctttgaaacgaggacggaggaagtttcctttgaataatgcagcattttcaacatagaaaattctccaaacgcaacgcagaaatgacctctgctttctccaacgtcaaacttgtttagttttatctatgtcatctctctaattctcttgtaaatctcaataatacctcttcacttaatctttttaatatttctcttttggatggtgaggatttgtgttttc

SEQ ID NO: 5149 - DNA, 2000 bp, Arabidopsis thaliana
atttcggtaattttatataaaataaaacaaaatagttttaacaaaattcaaacgagtgttatatatacattagtgagattatgcaacgagaataaaaaaacaataacggataagagtagggctcaataatcgaatggcagagagcgaatgatagggaaaatgtggggtcaagtggagacactcgtgactacggtggtctttattgcagacaataacttctcctgtctcatatgccttttgaaaacgtaaattgcaaaaatgatttgtcgtgtttcacttcttttgtcctcgcaatttcgcattctctttctctattctaacgaaaaacgcgtctaaccatttcgtagatgaaaagttgtagaagatttgagcagcttatcaatttcgcattctttttctcaattataaacgcgtctatccatttataagttgagaagtgtaaaggatatataacttgaatgattatcaacaaaatgtagggaaaataagccaaaaataaaaacgagttaacaaaaccgactctattgtgaattcataatataggtactaaaatttatattgtatcactatttcttattaaaaaaagtgttaccgttcatttatatacctctatattttctcgaaaactatactttaaaaactacatagaaaaacatgcataaaatcttaaaacaagtttgtttttctaaaacatatttgtataaaggaaccgtgggagtatatatatgttaatatgtactatatattttgtcattcaacgtatgttttcttcgaaagctaccaatatgtgtaaaactaatgttgcaaagtggtgttacttgggaaaattcggttaggaacaaaggggctaaataagtcgctttgtttacgcaactcatcttctattcttctttatatatcacgcgtttttcgtgggcttcaatgggccacatgaggtcgacatttttaacctttatattcaaaagtacggcaaaaatacatcatgcgccacgtggctttctttgtttatcataatctcacacgtctcacgtgtgacaaatgctaacgctaacttaactagtgggtttggttagccaaaataccaaatgatacaataagaaaacaagctgagttacttggcaacaaaatttagttcgaggtgagaaattcatgtgcaattgaatattagtatgactcgtctggctttaacatcaaaatcaagcacaaaacagaaaaatacgtcatcaaagcaataactatttgactaattaagaaactcattttcttgtttgcaaacccttttttatatatttgtagttttgtagacaaacgaacgtgatgcgtttggaccagcgtcacagacgttgacggctttgggacacgtttgaagaaagaatacgtcgacatttcttatttcagacttgctctctttttaggttcactacacgaattttcacgtacacaacttcacaacacgttttagttacgagattctgtttttttgttcgataatttattttagtaacacgtaaatagatgatttatatggttggtataattataaatgcaccgacagacttgaaactagaaattctaccgacagaaattcttgctcggaaaccatagactacctaccctattaatgtcaatgctatttgattaaaaacaaaagcattaattgatcttagagttatgggtttatattttataggaaagagtaaaagctcattatatttatgggcttatagaaaagagcaatagcccatttaaccgacttactctatcgggtataaccaaaaacccgataacccggctcgttcatcggggaattttccgttttctaaaagtaaatctctttgaaataaaaaagcttctccgtttccctcttttgaaaaaatcagaaaccctaaaatcgccactctctcgtctctcttcgcggtccattctgcttcatctctcccggcgaaaccttaatcgaacagctcggattcgatcctattctctgttgttttctaagaaag

SEQ ID NO: 5150 - DNA, 735 bp, Arabidopsis thaliana
gtgaatcaacaaaaagaatcagagattattctttcaagtgatgatcatgatcatgatcatacgcaaaactatatagtattgtagaacacagattgtatgtggctttctttttttttttggttcttaaacctaagatgatgtgtgtgtttgtcaatatagtcttcttagcaatgaaaatcgataaagaattaacacagcgagaatgttacggatatgtaacgtaaccttccaagaaaaggtactaaatttcaaaaaagtcaatgtgttcctcataatttcaatctatgagtcaataatcactttaccatagactaaaattcattttgttaactttttgtgtagaagaaaagcaaaggatagcttctcttctatggtaaagatgcgaatctgtagtttgtttgatgttctctgcaaaattcgcatgtataaaattaattaaacgtttagaaatataatagatgaactttatagtacaaaggatccgtggcgcaatggtagcgcgtctgactccagatcagaaggttgcgtgttcgattcacgtcgggttcaaatatcccgaatcttgatccttaatttttttttcctcttgggcttactacgactacataaggaggaagcccatatatgcccaacaactaaaatccagttcataacagaaaccctcgttaaacctaacgccgtaattatcgcctccggcatatcaatcctccgccttctcattcttctccagacgcc

SEQ ID NO: 5151 - DNA, 1065 bp, Arabidopsis thaliana
tatcacgagcgcgaggtctgattaactgttaaaagttcaattcaagagacagaatcacataagtaatccttctctaaaagcttttatcagaataaaagagacaaacctagagagaagaaggtccgtcggagatatagacttttccggtaagcagaagaggagggaaaacgaattgagtcggaagagagagaatgcgacgaagtacttataaaggtctctctgcgtcacattgacgtccggcgcagcgtttatcagacgctgggattaaaacattttcataccgaaaaaaggaaaaacattatcgggcctaatatttgggccttattatggcccaatgttgactttaattggaaaggaattcggttcgggtcgggtggttaaacggatcctaaacaaacccggcagatctcacacactatgagagctttccctctcttttcccctgcggcggctaactccgaccacttcagtgtgaagaactctggaatttaggggaatcaggacggttttagatttttatccgatcatcgtcaccgccgtaagttagcgtcgtctcagtaatggatttgtaagagaaatcggaaaggtcgcggtagagtcagtgattataagaaagaaaaccctagcttgtcgctttctttaccctctcggtgtttgtttctgtttccttcaatcatgacgtctctttctattcaaccatttccaggtaaatcttctttgtgttgctattgatgtttgagtctctgctatgtttttatccttagctactcaagtcgtgcgcctgaacttgggctattaatgttttacatatcatgttagcttcagaatcatgttcatcattcaactcttataaaattcgagtttgtaacactgatgcttagagtacattgatttgctttttgtttttttctgatgtttgagtctctgctatgtttttatctgaccttacccgctcaagtcctgttctaagttcatttgattcagaatcgtgtgctacttaggttgtaacttttatcatctgattttgaaattttcaaaaattctatgtcgacagagatttcaagg

SEQ ID NO: 5152 - DNA, 2000 bp, Arabidopsis thaliana
taactgactaacaagtttttttttgtttcttaactaaccagggggttgatttaatttatgaagttaacataaaaaaaaaattacatgaccatggaagccacagtcaaaatattctattatggaagtaaattttttaaaaatgtattttctttagtaaataaaaaaaacgaaagcgacaagagtagaaaacacattacaagagtatattagtctaccctaagttaataagttttatgtccacacgctatttcggcaaaacttcacattatgattactctacttaagcatttcattaatggtaagcaattagacgttaacagagtaattaataaataaacagtggtagtgcagctactgccgtccaaaagtcaatggtcagagtggcattcaagtaaataatccacataaatgggggcattttattagctccaagagagtcatgacaatttgcacttttattatatctcaatctccttcttcttcctcaagctgattcttgagtatgcaaggaaaacttctcttttgtccccttgtcaacaaaaatctcccattcaacaaaatttcttcagcttctctccttcaaaaggttagctttcatggtgatctctgtagtcactttctcctttttattttcttgtcaaaacgattcaatttcatttgtttctaaattgaacaattgcttcttccttagctctgctctcatctggttttaagcttttggtcctaggggttaggaatctgagcttatatgtgccttttttgattgtttgtttttgaaaggatatgacttgtttgatttggttttggcgcaaaaagcgattattccctgtaacccaacatcgatttgtctacctgtccctttgtttgccttgtgttgattcaaaagtactaaactttatcctgatgattgtgtaaaaatcttgacttggagcctaggttttaaagctttgaaatcccttagtttaacctgattctggtaaaaaaccctgctttagggtatgactccaaccttcgaatagatgtaatttcttctgtagagagagatatatagagagtgtaaagcttccattttttggggttccttttatctggcaatagaaatctgaaggcagtagcaaaaaccgatatatgatttctgaaagatgtcagatctgttttctgataaccctatgatgacttgagtgattgattgtgagagcagactttgtcgcatatgtttgagtttgtttagagaaaaattcacaactagaccttttttttcttcttctatcacaaatcacagtgtctgtatttagttgctttactctgttgtagctcacttgttgtttttggatgttttcatggaggcaggtttttattctccttggtttgaacaagttacactgtagagagtgatttggctaaaagaagattgattcaggagctgtgtagtgtattgctggggtttttccaatgcaaacgtctcagaaacatcacagtgcggctggactgcacatgctgtatcctcaagtctactgttcacctcagtttcaagcgaaagacaacaaaggcttctctgatatcccgtccaaagaaaacttttttaccctcgaatcctccactgcttctggtagtcttccttcgtatgactctccttctgtgagcattacatctggccggagcccgtttctcctcagggctctcagtcttgcatctcggatctccatcattcccctgacaacgtctatggatcacctttgagtggggtgtcatctcttgcctatgatgaagctggagtcaagagtaagattcgggaacttgaggtctcgctgctgagtggtgatacaaaagttgaagaattctcaggttttagccccgctgctgggaagtcgtggaactgggatgaacttttggctttgactccacagttggacttgaaagaggtgctggtggaggctgctcgggcagtcgctgatggggatttcgctacagcgtatggattccttgatgtcttggaacag

SEQ ID NO: 5153 - DNA, 520 bp, Arabidopsis thaliana
accacgaaaatactcatgcttgcaataacgagtaggagagaaactgacccattgctagtgattcgtgtatccttgtgttaggttacacacgtttttttaaccactcaagtctacgtcacaaaaaaaatcaatttaccactaatattttatcttatcctcaattattgacccgtactataatttattttatagactagatgtagaatatattatataatagccaatagggatcggtgggaagagattcatttctttaagttataggtctggagcggccgttttgaacttctgattattaaatcagattctagactaattaagaagcaggcacaaaaagaaatagattacgtttcttattttcttgcgttgttttcactacatttattgctattgcgttacgtttttttaaactacgtttattgcttaatgctagtatttgattatcttgttaatataattttcgttacggttctttagacgttaatgcaacgatcccatgctccttcctgcaggttgaaaa

SEQ ID NO: 5154 - DNA, 784 bp, Arabidopsis thaliana
gatctgtaaacgctatacgatgatgtttgtagagtctgagtcatatgagtgtttcttgttgtttttgttttttgtgatatataccataaaagatgtctttgcgatccaatggtctggtcattgtggagtaatagacatgaacatgatatacttgagaaataatgtgatattgtagaagttttaagcgttggtctgaaatcaaactgtgagattcttaaaaggcgatcgttttacttttatgtcgccgaaacggaacaaattcaaacggtaaagccaactatactttgatcagttttgggttgggccgttgacactgttttgtgggcttctcagtcagtggtaaacctaaaattaatataggaactcgaggattagggcccaatccattttaacacgtgatgatatcatgtaaggtttggagggaatatacaaaaagtggatgaatgatagcgaacgagaggtccttgtgcttttttgatttaccctcgagactcgtgccgacggagtggccgtggctttcgtgcaacagtctcgacccatacctcgacacgtgttgaaaacggtccattaagagtaagacatctgtcaataggacagctgtcctagaggtcactcgtctctcacaatccaatccctttcgcttaaattaaaactaaaatggagcatggcagcaacatgccacgtggctcaccagtttcaaatctgagccgtccggtgtgatataagtctttttaaagagagagagagcggttcgtttgtctgcaacggcaccaagtctttgaca

SEQ ID NO: 5155 - DNA, 1420 bp, Arabidopsis thaliana
ccagttgacctaggcatcttatatatatagaatcatagaaatgctttgttctgttacgtgtacgataaacatacacgtttactcatttcaaatgtgcaaccataactttgcgagttctccaccatatagctgtgttgttgttgatattgcttggactccacaaaacaaattaccaatcaggacgaaaaaaaaacaagtatgtccaacgtatttatcaaacttcttttttaaaaaaagaagtagaatcacaattagatctattggttcctttcaaaacgattatacagctaactaggagatacagtactttcatattgtgaccgaaaccatccgaaaaaatgttcaagatctttttgtttctattctgagcttatgtttatatatataaaaaaaaaaaaaggtggaatgacccgaaataatcgtcttatctgtatgtgtttctaatttctattagtgttcaagcaaaactataggtggtctagtagaacgtctgattgtgttatttaaaaatttagtgttactagtagtacgtctaatcattttttgtattgaatatataaattgtgttatcttatttattatttaaaagcatgataaaatttaatatttgttatataattaatattgtagaaataaatgcaaagttggttatcattagaaaattgtgattaattcgatttcaaaatatacaattacgttaaaatcagatttatttaagatacaaattttggttgtcgtatttgttatataattatgtttagtttgtgcatccattaataatttgcactgtggatgtatatattacataaatccaaaaattgagtggtaattacgtaaagtgtaaagttgtgcataagtccaaaagatcaaaaagaactttaaaactcacaagaattttgtgtaaagaacttacagaatccagacatgcaaaacctttttactggataccttttatgactacaaagtaaggtattcgaaatatacaaattatgatattattgtatttaagaaagttatttgaaatatactaataaggtatataattttaagagataaataattctgtggctattaaaaaatcaaacatatagaagtagaagatgaaatatatttttttttggtaaaatattatttttgtttattttatctttgaatagcaaaatggattgtttcagtttaattgtgatgtgtgattgggttgtcagtaatattgtagagatttctttgctttttaggcataggatttgtccatttgagaggaaattttattttgcccattaaagcaaagaaagaagaaaatctgagtggaccctagtaacgtaacatacgtagaaaaactttgattatataaccctgtccaacagaacataaattaacaagagaaatctctaagaactgtgaaaccaaaataataaaaaaa

SEQ ID NO: 5156 - DNA, 475 bp, Arabidopsis thaliana
tgttgaattttggagggaggctccgataaatttgctcgagtgtgagcggattatctgttatcttttaaactttcggaacacaaaattactgttttaccctctctttttttttttaaattctatttccttaatctactaaagattttcataacaaaactatatgataatcaaaagtatgaaatcatgcatgattgataacatttcgtttctttaacgaaacctgtagcattgtttatggaaaattggtatatacgtatacaaatccatctttgatatttctcagaagccgacaggaaaatgggtctcagatagtaatagttatctaaacatgatatattttgtaattagtcggatatattaaaatacgcgttcagatattcaaattagaatagtcatatagtcacgcggttataaacaattcggtgtataaattgtaagtcacacagaaaaagaaagaaacgaaacgaaacgaatt

SEQ ID NO: 5157 - DNA, 1098 bp, Arabidopsis thaliana
tgcgtcttcgagctctctctagcgtccctttactcttttgcggtgttgttataagagattagaaaccctagagaaaaatgaagaagaagacggctaagagttaataatcagattttaggttatatttgggctttgactgtgagtataaaacccaacacacatctaatgggctgagttttatatcttatgggccagggattataaaatcctagtagtgaaatcttgtaccaaaatcatttattaatgcaagaaaatactaaaaaagtgaatagagagttgtataattagacacgcgccgattgaactgttattttttgtttttgaaggagaattatttgatttcaaatataataataacataatttagcttttcagaataaatttcttctcttttctttttctttttgacatgtctaattagattgtgaatgaaggagtaatcttagaagaagttttggttaaagacgttatcgtaatcaataatgtgatggaaaagtgtaattatgagtcgcgtaatgaaccaaccatacatttgtcaacaagttgatacaaagacataaatgcatgtttatccatccccaagttcaatattcaaagactaaattatgagcatttcataatgactcagtatgccatttggtcaaatgaaaaaccaagccggtcaagcaccaacggctgaaacattcatattcaaatatgaaaagtaaaatcttggactcgttcaatgtttctggtgacgtcatctactacgaggaaaatatcccaaccaaaacgcagcgtaattgcatggtcccctgtttttttggggtcgctttattcctctgtgactcctctcttttcatcttctataaatcagacaacaactaactctttccctctcgctctccgcataaatccctttgaaacaagatcatatcttaactttgtataaaaacaggacaaaaaaacagaggatcatggttatgtatgaagaggttagtgtctttatatatgtttccaagctcatgtagagctctgtgactgtagaaaagtgatagttattcctttctttttttgatcctataatctcgatctagcagaatcattctattaggtcta

SEQ ID NO: 5158 - DNA, 437 bp, Arabidopsis thaliana
ttcatgccaagttcaggaatacacgtgtgttttgaataacaaaatatttccttattcaatgtatcagatttgttttaatcttgttgaactttacacatttgttcccgattaaactttgacatttgctgatttgctccataaaataagcttagtgaaacttggagcctcaaactaacaaatattgtagcctattcaactaattgcagcccaagtccaatatgtttgggcccataatgaaagtaagcccataaacaagagtgtattcatttataaaccctagaaatttcccacttcccgatttgcacagccaaacccccccaattttggcctctcgatttagttttttgaaaccctaagctcgatttcgatcctccggcatactcggtttcgccgccgaatctctgcttgtagcgagtgttactattcaatcggcgaga

SEQ ID NO: 5159 - DNA, 1024 bp, Arabidopsis thaliana
tcatttccattttttctatttgaaaattttaatattatgaagaggagacaaaaatatagacccgtcggtaatcacttatctttgttttgacaataatattataagtcaagtactagtttccatcttccacagttagtaaacaaaactgttactgtattttataagatcatctttaccattaatagtgtgaaacaaattaaaagacaaagtcacaactagataacaaccatattatatgcatttgggaaaaccttatcttatcttatcaaaaacagcaaaatatccccaattgaatcagtatagtgaatccagatcttcccaatttcatagttaaagacaagaaaatgaaatgtcattttgtgtgattgtgatattaatcattcacatattaacatcattctcatcccatcgttaatccattacattttattgtatagatttgacacacaaaacaaaacaaaatgcatgcaaagacaattagtaaaacaacttctttttttgatctaacatcatgaataacatttggcatgacaacagaaattttatagtttcgataataatacagtaatactcatagttttatgattctgactgaatcgccaattgtttttcattaaagagaaaaatactatggtaaggaactaaggatccatgtggtaatcgaagagtcgtcgatcacgtgcaatcctccacacgtgttaagtcagctcgtagttgattcttcccccttgacggtcatctcatcggacggttgagatcagccaactttaagtgtatcacacggaaaagggaaatgtagcgcgagaaagtcaaaagatccaacggtcgatatgaaacaaaagtcagataatcgtacggtagaaacgaagctatatatagcaacaattggattattcttatcatcatcactctctgagatcgaagagaaagcaaaatcaaagttgtgatgaaatctctattgatgagaaccggttcgatgccggttcttcaaaaccggttaatttcaggtggttcatcgcggaag

SEQ ID NO: 5160 - DNA, 781 bp, Arabidopsis thaliana
tgctctcagctacgagaattggatacaattggtcgagctagagtgaaatcgccagttagaatcaaattactatgagatgtgttgtctgaaatcagactgatgcctgaaccaccggagaaacactgctttcgcttcgccgggaaatctcaccgacgacgaacatgatagcttaacttgatatcgttcgtcgtatgatcgtcactttgttgggcttttttacactttttgggctttgaattatctttgatttattatggcccatcatatattagttaacgggtctaggatgcaatgttatcaaagggggatatattggagatgaaagtgattaactgaaacataacattggttaacaaatcatttgcactattgaaggatgggtgttggtggggtcgcgaaaaacaaaggcatgctcaagaccgaggctggtgattgggtcatggccattccggacgacgaagacaagcctgtcgtcgcgtttgattagttgcaaacaaacaataagtctcttttcgtgtgtatcgattgatttggttgaattttcttctctctatttgattgggtttatttttactcttttttgtatggttgagaatgatgtgcaagtttgtggataattctatatgccaataatattcccacaccagtgataaccttttatcgctttggacataagtgggtcagacagcatcatcaccagtccacaaccatttgtataaagttaaacaacttaagagtcaagagtcacttattatctccttacacacaccatttctctcta

SEQ ID NO: 5161 - DNA, 2000 bp, Arabidopsis thaliana
gtgagtgtggaattttttcttccacagtttggtaatctagatcgtgatttgctagtgtatttcatacacattgttgtgagcttacgatacatagtctttagactttagcatatttaagaattgagaactatgttataatgtttaagtagattttaaagcaaattttgtttagtttgcttcgctgggacattttaaaaggagataaagttttaccgatgccaagtttttatcgttttacagttttttttttgtcaaacaactgatattaagttaacttgcgattataacaacttgaagctttgccacataactcacttgttgaaagtttaaaatagaaaaataaaggaaggggaaacatgaaagtaataagagagtagattaacatcatggatgataaccggaaactccttcgagaggattccataagcgatcggtttgaagacgatcgtcgactcttggtcttcaaataaagacgagagtgctggtagttcttctgccatcgaaggctgacgaacaacaataaagcttgatgccactagggttaagcgtttagaaacattttccctaaaggagaggattgatgaaaaaagtctctccttcgaagaggaggaaagaagaattggtctctcaatatatgaggaagaacatctcatatatgaggaaagtttctccaaaaaaggagaaaaatctctccaaattgtaggaaagtaacaaagaagactcgttaaaatcacaaagataaccggtaaaagtaatagaagcaaagagcaaacgttaccatgacatgactcatggtccaaatataatgggtctcgaggtacaaaggaagccataaacattggcccagctcaaaaatcatgacggcacgattggtgagcatagcagcaaacaagccatcgccggaaaagataggcaagaaggcggagccaggcatggaggtggtgggcacatcttcaatctctgggatactcatcggagaaggaggtaaaaggaccaaaaaagtgacagctatagatctcggaggaatatgggtgatgggtggtggtggcaatgaatctggcagatccggtgggtctggaggctccggtggacgagtcaagttggacggctccagaaaaaagtgacaaaggaaagttagagaactacaacttggacaggagaaaagacatcacagtagagcaaaacaccatggaacaacaattgaaacaagagaacagatctcatcggcggcaattattatatttcgagtcacttcttcagataataaaataaaaatattaactttgaaagcgatgtataatactttttctcccattctggttatattttatttcgcttctcttcatttttttttacatatttgtattatttcataaccattaatttttttgtattattaaaaaattgtaccattttagattaccactcatgcttgtagacttgtagttaaaaaaaatctccatttatttaacaaatttacaattaataaaaatagtacgagattgataatatttttgagttattgagaggttgataagaaaaagaaatatttataggggctaagaatctttattaacggcataatttagtctattactgtcatgacacgtggatttagatctttttgaatactattttttcttatatacatttacagcaaatcatttctctaacattttagggttttacgaaaaaaaaaccttcaccgtctctgctccgcgacgccgccttcgctttctcaaactccgatataatccttctcaggtaagcaatcttcttcgattctcattccttcgttctctaaggttttgtatcaatcgtagaaagttttaaactcgattttaatcggaatcaattttgtttcatcgagtttgttgttcgccgtggtgtcgaaaaccctaatttccgattcaaatctctagaaattagtgttgcgttatcaaatttgtgatcttgtattgattattcattcttttgattttgttgtgtgttacagagat

SEQ ID NO: 5162 - DNA, 2000 bp, Arabidopsis thaliana
gtttcgaacgtataatattcataaccaataaaatagtagagtcacttccaagaaactaggaaacatcaaaccacgtcgttgcattttggggatcttatgaaatacacaagcttatacaaaaaaaaatattataaaaaaatgaacgtatattaattcgtaattacataggcttaaaaccaagataagatcggtacatgttgaaaatgaaaattattcaatctcctaatagaggtgagacaattatcaattcgaaactcatacatcaatcataaaagctacaatattttctcaactccatcaattatccgtgggagtcatacaaaaaaaaaattaaaaaaattattacatatatatgtatttttttttcagaaaagtgaaatctctttcgaacatatgaaattatgaatattcatcaattggcctaggattacgagatcaacgtaaattatttaaataacaaaaataaaaaatatgtttccttgcattaggaagcatcattatccaaccacgacgccgggtattaagccaagatccattccaattattcattcatatctactacctaaaacgacattagctttttataaagaaagtcttaacccacgatcggtgttcatatttaaatattacatttgttgttaaacaccaatgttatgcctaacaacttaaataaaaccgccataattgttttttattgtgtttttgaaaaactacttgcccgttgttatcttgtggcctgagttttttttctcttttgtttttaatatatgtagtatgaaaccacgtttcaacaaatgggctgcgccaaatgttcacgcatcttgccttgagaattttgaataacaactaattagagattaaggtatggaaatgtacaaaaatcgccacgagatcctttcgtagatccacatggtattaccgggatacatggagaaacatgttttcttaagatcagtacattactcattaaatggtcgatattagtaaattatttttgtacgtaattgctcggtgcatggtttaagacgtgtgttcttaaaagctactccaattaataatgatgctttcatgtggtgtggaattaaaagttttggatgcgtagtggctaatcaaaaaatcataaagttcatagtttaagcttcgaaaatgcaaatagcttggggatacaaaagctatctttacaaaaatcttagaaatggtggagtcttacataatcacgtgtgtgatccaaattatagatgtaatagaagaaatttttcttgtattttcatgtattatatgcatcgcctttatcgtctacacatgaccaaaattttttcccattttcccatttttaatcctatacaaaagaagttttttttattgtacaaggcattaggtcaacaatgccatggtgtgaacaactttgtctccacatttttggggacatatcttaatctaattatcgctttcattacttccctaagcaacaagttgcttcatcttaattttcccattattgtataaaactatccatcaaccctgacaaatttaaacgatgaaagcctgaattattgataatgatattgatatcattatcatccaaacgatgaaagcctgaattattcagttttaaaaggatattcagttttctctcactgtcagctaacttagtcaaatcaaacattcataaatatatattacacaacatatagatctataagcatgacatttataaaaccatatattataaatcttatgatttattatcctaaactatttagaaagaatatgatgggttccttattcctctcaaatgcgtgtcctagaagttccacaagtctaaccaagacgtatacacaatgatacacaataataattcattttccaaacgttgatggtatttgagtaatttcaaatctctacagaaaaatatttctctttccctatatatatccgataccatctcattgcactttcaacctcaaacaaataaccaatcaaccaaaaaaaaaaaaaaa

SEQ ID NO: 5163 - DNA, 2000 bp, Arabidopsis thaliana
aggaagctctggtactatctttctcattaagcatccgcgactacaatattccccaatttattaaataaacttttccatgatgcaaaagtaccttttattaaacactacgaataaataaataaaggtgaaacacccatttcaaagaaatggtaacgtgtctttttcattaggcgagactagccaatctaagcaaacagagtcgtctttatatctaaacgaacattttgtgaaagaaagagagactaaggtgaatccatggcgtccaagattgtctcagccatagtatttgtgtttaacctcattgcctttggtttagccgttgctgctgaacaaagaagaagcactgtgagtcacatctccacagcgatatctaatttgaacaagatgataattatgtgatctatcttaatattttggagttaaatattttttggtggggcaggcaagggttgtgcaggacactgaggtgcaatataactactgtgtgtatgactcggacagagctacagggtatggagttggagcctttttgttctcagtggctagtcaaatccttatcatgctcgttagccgttgcttctgttgtggaaagcctctcaagcctggcggttcacgcgctcttgccctcattctcttcattgttagctggtttgttattataactcaattagtacatcacatatatatccctagcttaagctagcttagacatatctggcgtttttatttcgttcaaagatgattcaaaactcacaatcaaacatttacaatagatcttagtttatagaactagaattatcattaatctatcatggtatcaaaatcgcagtaaatcttattatcagcttacacattttcattctcttttcaatgcacagttaataattcaaatctaacatgcgtctcttaatccgttatgaagctaaacgtgcttattaaacaaccgacattgtgctaatatttttacaacttgaatgttgttttgttggcgaaaaaaaggatgttcttcttgatagcggagatatgtctattagctggatcggtagagaatgcataccacacaaagtacaggacaatgttcatggacaatcctcctgattgtcaaactctacgtaaaggcgtctttgcagcaggcgcctcattcgtcttcttcaacgccattgtctctcagttctactatttcttctatttctctgctgctgaggcctctctttcaccttactagaggttcttaaccaacaaataagttttattttttttctctctaaatgtgctatttgatatgctaatatcatattttgaggtgggttttctatgtacaactatgatgaaatgttacaactatgacaaaattatttgaaagtgatggtacacatgagatttgtagatttatttgtatggttattagatcgagttgaaatgttgttttaaaaagagtggatgtaatttgacgattttgtgacatatgacataatgctcttattcattgaataaggtttgagctattctcgtgaatgcgtaaattcaaattcgtataatgcatacttttgacagagtaacaattgtttattactggagaaacttatccaaacatgagaacgtccataacaactagtagcaagcaactagctctatctatctccttctcccatgccaaagggtatggaatcccatcaacaccaatcagcaatcaccatccctttattgcaactgttccatttgttaacccaaaaaaatagtttaaagacattaaaataaaatatctaaggagaaggaaatctaattctcaaattctcattggatattaaacgacgacgtggcagatacttagttcaagataatgctatccacacatcttcggtgacctctgtggggaccaatcttcctttgtccgaatatctcatttgctagtacataaacgcacatactctctttcgcaaaatatccactacgatagttttcttcagcaatcacactctctctttgttcgagtaccaaca

SEQ ID NO: 5164 - DNA, 867 bp, Arabidopsis thaliana
aaacatttacagtttaacaaagcctttgaagatctgaaagagagaagattgttagaagtagttgttgagagtattttgtttgtatattatgagagattaagcacaacatgagaagagcctttaggaatccttaattaggccatctagtttttattgtctctcctctctttgattagattcttcttctaagtgtcatcactattgatttgttgtagcaccaaacttctttaaacctttctattaagaacacacaaatctacaacctttttattttttttaattgtttatgtgatttgttttctgtggcagtgaattttttatattatcaacttatcatgttagctcaagattgcatctcaatttgtacttatcttagtggtaattagaaaaaaaaacaaaattaggctacaatagttttgtttgtttgtttgtttaggtgttagggatagggtttattttttccgaagtttattagtgtttactatttagagtttaatgtttccaaaattttatggtttaatttatactctcagattaggttaaacatttttatttttaaaaatctataatatttttctaattttactttaaattgtagactaaataattgattcagccttatattatatcttaaactttgcaagaatcactttggcttgtaatgaaatgaaatccactgttttcatattcaaagtgattctagtcttgtattaactattaaatattccaatctttaacaacaaagaaaactataatattcaaagccatgtatataataatggacatggtccaataatttggcaatttaaaaaaatattaaagagaaaagtagattcaaataaagtggtctatatttcaaattgcaaa

SEQ ID NO: 5165 - DNA, 2000 bp, Arabidopsis thaliana
ttcttcttcttctaccataaaaaaaggaacatcgtgtcctcatgcttgttgttagcttgggaaatcatgcgacagtttttgtttttaatctattttcaaagtcaatatatgaacagtaaggtttataacaaaaataattgcatccccgacaagaaagacgttgaatgatcgatcttttgaagccatttcttacttactgtacattgttttctaatgtgcatatcattcaaaagtttgacatttgttatctctgcaagagagtgtgttgtagaaagtcagttgtcgaatttacccccctttttcaaaagtcacattcaggtcactgcttggaaaagaaacactttttttctttctgactcgggtatccgattctcttttcttctgttgttactaaacaagagttaatttgcttgacagtagtcttataatctttgggaaaaaggttagttaaattgtattttatctggtgtctttgtgcaacattatagaagacactaacttaagcatcctcctttatgcataatttgatttgaccccttacttgttagtggttgaaagctataacgaatatcaaattggagtttaattaatcttattttcacacgtgtttttgacattgtggctaccaacaacatctctgtccataccaagtgcttgtttaacgtttacatgagacttcagtttgtttgttttttggctagttaggggtaaaaattccattcttcttttttattggtctgtaaaaaaaattccatttcaagtaagaagaaagggagatgtttctacgttgtattccccatagtcaaatctaacgtcagcttcggccgagtgagaggggtcaatttcattcagcttaaatccaacttttttttctatgtctcataaataaatttctctttggttacaaaaaaaagtaaaaaagtttggtcaggaagagaggagcgaggacccaccgattacgtcatctcgtctaagaagtaatcagaaaaaaaaaaacctaatttttaaaataaaaacatcttctcgtgattgcgaagtttgtttgtgtgtgctgtgtggtgaagggtgatctctctctccgccccgaatctccgggcgatgcgatttttatcactgttggtttaataatctacttcacggtggtgtgttttaaaataactgaaatagttccggtcgaaatttgtaggttttcgagattttttttttttttggttggaaaaataaaaagtctctgttttcagaccgaatcttttgatgtatcacttgcatggctgtgaaggctctgtgtagcctgtaaagcttacacgaggattttgttgctccccttaatttccctctaatatctctccttctctctctctctacgataataatgtcttctctgcaccgtttcctttcgccttctttctgtccgtttccaaatttctttcgtttcttctttttggctctatttacttgccatctctctcgatgataacgacatgaaacccacctcaaacaaaaccacattcacttattattagcctttgtttttttttgagtggccgtgaaggtgtgtgattctggtgccctttcttcctttttgtttccctgcttaaggtattcctgatttttttccgtttcttgggatttattctgtgccattttttttgtttctgtttccaaattcttggctagttaattacgacctcaggatcatgtggatcctgttctttttgttatcctcttcatcagtgtttgacactatcttgtgttttttccctctttttcaataaccttagatgcttattccttggcctgatgggacacaagtgatatcagtgtatggtgatagacaacgacattttcatattcttccttttttttttttcttctttaatgttatttatgtttttttacttgacacttggtttcttgatatgtcctgatttgctttgacaacaaaaaatgcaggttaccgttgatagagtggtgttttggttctgttttggtgtgagcgt

SEQ ID NO: 5166 - DNA, 2000 bp, Arabidopsis thaliana
atttccttttaaaaaaatagccatttgttttgttttaagataagagctaagacatataactacttcctaattaactttggaaaaaagtatattgtcgcaagttgcaactcttgtgccataaaaagcaagtgttcaacacatgtttatagtgatgcctcatcaacagctcaattaaattgaaacgtaagtataatacacaatcatctacatatttttgcagacattttagcaaataaatcgtagagttgaacttatttacaactcaatgtcattagcattaaatcttttttccaaaataattcattttactttaaattcttaatttaaattgtcaatcacattatcaatcaaatttaatccaaacaaacttcccatcaatcctttaaaattagcataaacgtatttgttaacaatatttaaaacaaagtttttgtttaaataaatattattcttactaaacgttttttgtttaaataaataaatcctgtatttgaacttatttacaatttcatgctactggcattaattatttaggaatgaaaatatttaattaaagatttaaatcttctaaatccttgcttttagatttattatgtcattacctaaaaggcaaaaactattagttttttaaatattattatttatattttaaatttttttaacattactaatatttaaacttataaaaagtttaatatatcaaaaaatcttaacatcattatataatatatagagtttttaaaaatctcaaatttttttccgtcatattttgtgattcaaaatttaaaaaatgaacatatattaaccaattggcgaaaaatatgtgagttcaacgtcccattttgactaaaatatttagagaatgattcataaacatatcataaataagatcaacattaacaaaataaatggtttttttttttgcgggacgagtttggcaggacgttacttaataacaattgtaaactataaaataaaaatattttatagatagatataatatataaatttttatatatattaacttaaaaaaataaattgtcctgcggtatactgcagattaaaatgtatattaatacttacgacggacgtgtacaaaatattatatagccccaaaaatagcgctgcatataaaaaccacatctacctaagcctaccatgtagtgtagttgcatataagacaactataaattaataatgtagtttaatattttttttggattggtttctttgtttttggttaagtttttttttcttgggggtataatgattttagttaagttttgtttaagtttcctcaatgacaaaggtacaatttcggcgttacgtctagtctaaaataatctattaacaaaagaatgtacttaattagtcaatactctactcaatagtaggatatcgtttcagttttgtatgtggatttttttttaaatttttgaaaaattctattcaatttcaataaaaaatttctgaggatagtcaatgaaaaccaaaaaagccataataataataattataaagtaatatatcaaaacgctcatataatattccacatacatttactgtataatcagaaaactaaatagtatagttatcaagggtccctcttaataaaaccaatattattcaactaagatatactttatttatttggagataatttaattttcgtaagcaccatataaaaaaacaatgacgcaaattattattttgtttatgtgataaataaagaaatataaaacgagagaaaacaaaaagagtgagtgatagtgattacaaaggtaagccaaaatttgaatatttaatggataccaccagataagaagaactttgcttcaaagcggcaaagcttaagcttttttctcgcgcccgcctctctctctctctctctctctctctctctctctctctctctctcttctcctctaaccaaatttcccgatgtgaaaaaacaagtttccgatcaactcaaaccaccgtcaccacttcttctctccgac

SEQ ID NO: 5167 - DNA, 1150 bp, Arabidopsis thaliana
tacagtggtgatgatctgaaaatatggtggtgcttgtgcatgtgtgtgtctttgaaagagaaattggttgtgattaaaattagacaaaacagagccgtttaaatctcttccggtctaatccggtttagtcggtttattccggtctgattcaattgaataaaatagtcgttgcagatttgcagttgttttccgtaaaaataacgtgcggcacagtgcatgttaatcattgtattcacaaaactgaaactacataaataactaatctttcccgccagagcctcacttatgggccaaagcctatttattataagttttgggtcaatatttgatcttttagcccattattgtcaatggtttaaacatagaaagatactattgttgtaggttgaacaaaagataagaaaaaaaaaggatctttgtaagaatctttcttaaacttgtatttttgtcgacatctttgttaagcttcttctggctgtcaaatagtgtcttttaatggttcgtcacatgtgccactggcctacactacgtaacaacacattcgtattcacaccttgtcctcgtatactctacgtcaactttaacccaacttgtgacaaaatcttatctttggctcttcttcactcataataactctaataagtctttaactacccaacccaatgtagttagacgtgtctgtcttatggacgtggaatgctctcttctacttacttaagcaacaagttaaatccgcaagaaagaaaagaaaattgagcttgatgtcttttaatttgtctgttcttctcaaaacccttgaccccgcagtctgcagtccgaaatcaacggcttcatctatgataaaaattggaaatcttcttcaaccaatagtaaatatcagtgtctacatcaacattaagatcaccagcgatctaaatgatgcagaacaggcaggcaaagaaaagaggcgttttgtttgtttctaagagtggtccttcttcttggacgtccataatggtttctaaaagcttatctccgtctttcgaatgttcaccacacagtttatcccacacctctctatataaacacccgagaccgagaggagtgagaagagtagggaaaaagaaaagaaaagtagagtactatcttcctcttaaaccaaccattcaaa

SEQ ID NO: 5168 - DNA, 427 bp, Arabidopsis thaliana
actggtaagaagtaagaaaggaaaaaagaaaaattcaacaaaaaaatatgttggtgttggtgaaggatgtgaacttgattcgttgtgtaaatgggttaaaagtatggttttcgagtttttggggctgatttgtaatctaaaaattgttgcattgaggttgaagagaattgtttgttgttttacgaggaaaatattcgttaattctttaattagatgtgttcagaaatagaaagtctttatttgtttaagaaattgtaacaagttcttgcgatgatgaaaagaatgagatttaatgggctttgagcccaactcatgtaaagcctttatagtatataagaagataaaaattcgaagataaaaaccaaaaccctatccactttactctaaacctccattaccttcgtctttcttcctcagtcgccctaca

SEQ ID NO: 5169 - DNA, 922 bp, Arabidopsis thaliana
acactcaaaagtcttaacgtatttagatgtgagaatccttaagattaacattgaggaacactcggttataactacaatcgtaaatgtaaattgtcttagtctatatgatctttttggtcacaacaggtaatttcattttcctttgattacttctcgtgaaaaaacaaattaacagttgtggttttccattgatttcaaaaattatctcaaattttggctaaaaaaagaaaaagaaaagagagatgcttcagaatcagaagagaacagtccacttaaaagtcttaaaccctaaaatgaaatccttccatctaaaacgcagtaaacgtcaccgtttgattcttcgtgacccacctaactacgatacactagcttgtagaggataaatgctccgagccctataaacacaaactatgtggagctactaaaggagaagtctttctctctcgatcaagccaagtaaaaaaaaaatcctaatctttgcgtcaccgttcgtgtttcctcttctctctagggttctccttcaacagttttccagtaaacatgaggtaacaaataagaaatcctttttctcttctctctagggatctttacctaaactcttcccttcgataaatcgtgcttctcagattcatttcgtgcttttgttgctttgttcacttcaatttttcatttttactcatgggtttctctgggaatcttggtttcttttttcaatcggttgatttagtgctacgctttcattggattcctgatgactgctgaaaaaaattttagggttttaaattggggttagggtttattgtgttgggtaccggaatttctctgtacattatagccagcaattgtttctgaatatatctgcatcaatctcttcttgtttagacctgaatcttagagcagttggatttagggtttagggttt

SEQ ID NO: 5170 - DNA, 559 bp, Arabidopsis thaliana
ttgtagtcggaggagacgccgataaacctcaaaatccacccaccaacaaaaattcaaactttttcgtttttgtcttgaatcaatacccattttcgcgtaatgtgagttccttaaaagccagcagaagaatctcgaaaccagaaaatctgaaaattttattgaataataatctctctcaacattgtaacatgtaactagaaattcaagaagggctaaaaataataacactaaaaacagcaacaaacctcaaataaagaaactgaatttcgccaaggagaagccattccaacggaatacataacataagagagagaatttgaaaatacagagacaatgaaactctaattaggtagatgatgatcatcatcgggctgttatttatttattatccattagtggataaatgggcctttaccaaaactatgggcccaataagtagacacgaattagtaaattgacccgacacagagcattaggtgaaattctaaaattcgattgatttccgtctctctactctcgttgctttgcttcgtgccgtcgtgcgtctgacctaatcagc

SEQ ID NO: 5171 - DNA, 536 bp, Arabidopsis thaliana
ggcttgtgagagagagtttgaaagttgaaacggaaagtggtgagtgataatcgtgaagtactactgtctgctttttggtgcttggttatgtgtaattccttaccaagggaatctatagtgtagtgccacttggcaaaattccaaaaccatgaatgaaatatatacgttaaatttggctcaacggtagggagtgttcattgataatgtactcttacgttttttaatatgcatattgcttgtcacttttcttccacaattctgtcttttaattacatgatttggtgttttttctttgaaagacgagctagcaaaattaaatgaagagggaatgcaattttcgaagtatcacaacaagtggtcggaaagtagatagaatgatattttgatcatccacgtggcaaaacattgtaacggaaggaaattaggtgcatagcaaaaaaaaataacacaatcgtgccaccgaaccaatcgggccgcccttttctaccgccggctaaatttgacggtcacatatagagccccaaaaactctccacc

SEQ ID NO: 5172 - DNA, 2000 bp, Arabidopsis thaliana
tttatcgactcatatgaacctaagcatgatttcgactctaataataacaacgtccaaacatatcatagaaattagtttacatttgtatataactatatatatatatatatatatatatatatatatatatatatatcaattcaaagaaacaataatttcggtgttggagcccaatttgcttgttgcctagctaggggtaattagatagggacaatgcgtaaatttactctctcttttcttttgggttcagttcctattattgaaacaaaaattacatccaaaatggatataggagttgtgaccgtatgggttgtcgaatggttgtgttatatacttatatgttatttgctaaacaaagttcatctagaacctccaattcaaagccagaaatcagttaaaaatcaatatttgctaaaatgttgattcggatcattcattcatttttataaaaaggaaaaaaattaatcggttctggttaacggtccaaaaatattatgtagattaaatatatataacttttcggtactaaaaaaaaaagattaaacaaccaagagtggaaacgaaaagaaaaacaacaaagaaaagatcatggaccataagaaaaatactagtaatacttaaaaccaaacataaagattgatctagaaatcggtttaaaataaaaataaaaaagaggaaattagataaagacgaagagtgggtcataactcataagaagaagtgcaagctgtgaaatgaagcattcgcaaaaaggaccactcacgtctacttcctctcatccttcttgtctcaaccacatcaactctcttttttagctccatttttgtcattaattaattaaccatacttacaattttaatgtccttccattttctatttttgtttcttaatttcctcaaattattgtgatggattcccaagacaacggagatcaacacaaaataaaacttgaaattgagcattattgacatcatccatccataaccatatagttttggtctttcaaaattgtggtgttttccattttttcgcagatcacatacatcgtatgaagagcgttcatatttcaaaaccggaacaagaagtcattgtatacgtcaagatattagtttatgttataatataacaatctcataaaaaaaaactcactatggaagtcaaaagtcaatcgttcaacttacttattatatttacatatatcaatgaatcaggattttttggtagaaccaaaacttaccaaacccaagcgacccaaactaataatagagtttaggtctaagtacatcatagaagtcaatacaattgtacagtaatacattggcttttagtctacttctatctaaagcaagattcacataaacattgaatttcatacaatttaataagtaaaaattcgttggaaaaaaagttataccgaatccattgatcaaagttaaaacaagagaccacacataatacaaccttatttcccccaccaaaatattctcatctccgcatactcacaacttttatacgcaccaccaaccgacccattttgaaaaagagaaaataaaccacaaaaacacacataaataatatgctgataacaatgtcttaaaaatctatttaccatttctagtaatcaatatctattgcaaaaaatatttataagaatacaaatgaaaaatgataaaatacaaatgatttctcaattacctaaaaaatataaaaatgtcttactttattttcagccactgttggaaagtacttgcaatcatatcgtattttgaattataaaactcagaaacaattattttccctgaaaagttaaaacttttaataagatatttataaaataaaaagaatagtctagaccgaaaatggggtcggttgtccatccaaaggagtgctataaatagaaccctccaagttctcattaggacacaacaactaaaaccacatttatcattacagtctgatttgagctaagttctctcatcataaactctccttggagaatc

SEQ ID NO: 5173 - DNA, 478 bp, Arabidopsis thaliana
gtctctcttcttctgtagcatttagctcgagttcttatgcacttcaaggcttctttttttggtggacaagatcatttgaatttttgttgtattatctaataaatattttaccgaaactatttaaacgaaaaaactgaagatttatttctgttttatttttcataatcatatgatttagagaatgagaatcgaataatctcagaatatttaagttaatatttcatttatcaatttagaatctttaccaaatatgcaaataattttacattaacgcaaatattccaaaataaaggaagcgttacgaaattaagggcaaaacgacgccgtgtagactctcgaagaaccctaaagagacttcttaaacctcattcgattataaaatagccccaaacccactgcctctttcactgcaatttctctctttcgcttctaaaaaaaaacctaacaacctctcttctctcttcctcgttcaacaaca

SEQ ID NO: 5174 - DNA, 1485 bp, Arabidopsis thaliana
ctgcattatgtgactgatctatgtaagtgtttttgattctccttatttttctgtgtttgcttagttacttagatgatgatgatgatgatgaatgaatgatggtttgtttcagggaagaagctgattctgaagaaatgggagcaaggaatacaaagaacgtttgtggtaaatacagttaccaaagtagctgtttgtatgatggtggtggaaacattttgacaccatcacaaaacttagtttgcttttcactagtgatgctctctctttgttttacgatcttgctcagctattctagcaattctcgttgaataagttatacaaagtcacaaatcttgcttcttttttatgatctcgattttgtagtttattgtagcaattgtggttgaattaagtatgttatagacaactcatagagtcatagacttggtgtctgatgcattgttaagtagacggttataagcaagcagcttaggagcaatttagatgggacttttatgctgaggaagtaggtggtaactctgtgaaaaggagggaaaactcactaaactaaaacatcaaaacgtagtagtttcatatgaaatcaacccccatattatatgctaatgtgccatttgggatggtcaaccaaaatctaactagaagtaagcaacactttagattgacaaggtattgtatagtaaggtgaaagcattcagcatctaagcttgagaaagcggacatcatctatgatcaaccatcgtttaaggttagtgacagaatccatgtcagacttttaacatatctttacatatgcatccatgttagggttgacggctttgactgaaaacatttatgcaaagaaataatggcaacaatcataatgtttgtgtaacataatacaatagtagcacttaggtacttgtgctttgtttttcacattgttgaaattcttgattgcttcttgaaacacttattcacattgccattgagtgtctctgaatctaaaaccagcccatttcttcaaaaatctaaaagatgtctttttcctcgatctccaaaagatattgcaacaatccctccccacttgttcttttcgtctacacagctctacccttggactgatataaagagtaaaaacaagttggctatttcttacaaataaaaagaaagaaaagaaaagtggttattggtccatattagataaatgagtaagagagaacctagtaaaccactgccgtagagaccaatgactacgaccaccacgcggtttgtgatgaagagggtcccaaaatggatacacttctctacctattttttaacatatcctacaaaatctcaatggtttttatttagttcgataaagtattattccgaatgtaaatagtggaacaaaaagaacagctgggaggattttgtttaaaaggacactacacttcccagctttccctcactgcccgaaaagaacactgcagaaacactttcctctgttcacagagaaagagagag

SEQ ID NO: 5175 - DNA, 643 bp, Arabidopsis thaliana
ataaattgtcttagatcaaaccaaagctctcgaatcttaaacaatttctacatgaccaatagctctggcctcttcaagctttccttatagttgctccgtttaagccattaaggtcatatcccaatgtattgttgtgtgagactatcagtgttcatggcttggccaagtatttattgaaagttatattattgagttgtgtttgatcatgtacacttatacaatgtaaagcttaattttatcttatctctaacataaaaaaaaaacgaaataaaaaattctaaatatatgttttcataagaatgatattggacacacgtcttagattaactgacttcacttcatagttaggctttcactgttatctctaatacttcgatcaagttttttgctaatttccatataatttaattacaacaaagtgtaaatagttctaaattgacaatctaagacttgaagcttatctagtaaaaccccactactaatcaaacattacatacagtgacttatagaccaagtcaagaagtcaacgtcaatgaaggacgaccattaaattactcaaagacttattaccaattacatgttccaccactacacatacagatctgtgacctctcttcttctattgtgagaaagagatcaacaa

SEQ ID NO: 5176 - DNA, 2000 bp, Arabidopsis thaliana
tcgatagctgatgataatcagtatgaagatgagagattaaacaagtgtcaagctgttgtttgctggaatccgtctcagtctacttactcacagtccataggaaccttccaacaaccgcggacactagagattactgagttggatgagacaggtgaggatgtggtaatggatgatgcatccaatgagatagaagaggatactggaagcaccagtctatctttccctcagcaaggacagcagcaagagcaagagcacacctatggttttggcttgcatccgtggcagcaagcgcaaaactgtatgattccgcagcttcctcaagtcagtactactcccactcccatcacttggttccgatgatacggcttaaccacgggaaaactgaatagggaatgcacgaagcaggatagtagaaggcagatttgttgttagtttttgtttctgccttttgcgcagattagagatatggcatagttttgttgttgtatgtttaccaaactaatagcttcagccatatctcccctaggatggttttgactttcgaatgttatcttttggatgtcgttaaaatatcctttgagataaactacgttccaacttaacatgcacatctacagttaaacagactctgatctattcttatctgctttcttgtgtcagtcctctagtggatttgtgagataatggaatttggtaataatcaaactttaggtttaaaaactttcagcatgaaaatccagttatttggaagcaaaaaccaaaaggacccatcttcttcatagaaagtatgttacactgcaaaacaaaatagatggtatacacaaaaaacaagctaaccacatgctttcagtttcttcgataagacaaacccaaaaaacgaagaaagaagacgggttatataccagagaagacgagataagttcactctcgtctagctagattatctatcagcaagttcgtcgttggagccaaagattgatagcgtcgatgtttttttctttttcgatggttggtaatgtgaattgttaagtccagactcggttggcgtacctagctgcaacgatatatgatcatctggagatatccatgccagtggattagctgaaaaataacaagacaagcgaaatgttagaaacttgtaaaagcatagacgttttcatgttaataaagttccctaaagacaccaatgttcggttcgagtatacgtcaaatacactcttgactgaaaaaatgacatcaataatctaaagccttgatacaaaagataaccacaattatatttatgtgccttgataagcaacacaccttctttagctacaggggtgtttgtattatcgatggaatccagtagtcgagctgggcgcttcctcacgtagtcatcctgcagcggtttcgggatttgaaacgagaactgtgaaagtttcaccccttctccaatgtattcggagttgtcattcaagtacctgcaaaccagtaatagtggttataagggtgtaaagaagctagctatacgtcactgaaaacaatttggtaatcactaaacgaattggtaagtcactaagcttttttctcctaccattgttgtcactctcaaatgctgcagggaagtatcatggaaataaggatgatagtttaactaacttcttggcatagtacattttcgttagtaaacaaaacacatgcaaggatttctgtaatttgcataagtgcctaactctagttatgaccacagaacaatacttgaggttcctactgattcaatatattggttgacgaaaatggtaagactgatacagtgagacctcatcaaacataaaagtaaggaacactttgttaaatgtgaaaacgaaaatgtggaaatggagtggtagagaaactaacttttggacctccacagttgatcgaagcttctttccagacggagcaacataataactgaaacaaccaagataaaagaatgataaagaaagccaatacaatggtataaagaagaaagacta

SEQ ID NO: 5177 - DNA, 2000 bp, Arabidopsis thaliana
aataaagttatgagttacttctttctaagtagttagtatgagttttccaatcaatctattttccacgttcagttttccaaattgtattgatcctgttatagtgtaattacgcattttgtaattggccatggtactacaatactaatactatcatgttatctgcagacttcaatcttttatttttaaaaattaattattagcatttgtaatattgatgtaattttaatacaaactgtttattaatttgtttgaaaacttatgtggacaaataaaattagtatacagaacaaaaaaatatgtttcaataccaaaaaaagttcactccctaagcttttctgtctcttaaggataacatcctggatgaggtctctcgatgattccccccacatacaacataaccatataaaaaaaaaatcatcagccaagtgaagcctcgggaacagtagtgtgaacctttggatccttggcctatcgtcaaatgatcgacgacggtcgagttgattgatcctacacagtacacaacctgaatgttttcccatagcatctctgcttcatctattccttgctagtaggattgatcccagaaaaccataaatttgttttataaagattgaacgtttgtctatagattaattttcaatggattaaacattgtaaattaatggtcttatggattttgtgagtttagattatcaaggttagaactgtgtattttgaaaagaataggtgatgcgtcatcacaatacacgcaaaaaaaaaaagtgaaaaatatataatactagtaagtagatttacaaagaagaatttttccaaaaaagaaagagttgatccgtcgaactcgttaattaagaaggctcgttgaattttacaaagcaaattctaaaaaaagatgcatctatttttacgatatctcgaatatatttattatgagtgttgttgataagaaagataaaaaattcgagaggcaaacaatagttttctgcaactatagagataattaataattcttatcagcttttcaatcatgagatctgttatttggtttatagtttcttatactctcatgttactcgttctgagaggtggtaaaggtaatatgttgagttttttttgtatggacgtaactcgtatataataagatataaaacaaggatgttctttctaattgcaaaaacggtgttgtgattaaaggaaataaaaagcattgttacaacgttaacatatggtttaatagtgaacttatttggattgtcatttgtttattaatcgaactaaaattaacgtttttttttttttttttggtttgtgtggttgagaaaacaatagaagtggaagctgagaaactgtgtacaacgataggagacttggacggtaaatgtagccaagacggagaaaagttgtgcatgagatacatgactgatcaatctaaaaaaaagtttcttagctgcacatgtaataacgttgttatgttacacaagtacaaacattattgcgaatgtcaatctcattgtactccaaaacaaacgtaagctgtaactctataatcaatatatctctttacaactaaataagaattgttgatagagtttgtagtgttttcacgactcaaaaatacaaatgttgtgctgattgaagtatgaatttttggttcaagtcttgatcttgatcattgaaaaaaatcgtgaaaatattgatcaattgccaacgaaaagacgtaatggggtgaatcagatagtgtaggattatttggggtaattttgttacattctaaagtatagtgggtggggttaaattgatagtattaaaaaagtcaagggttaatacgaaatacaaatataatcaatagcgaaaaaccaaaaaataaataaataaatgacaatttgactcgaaaactttaagagaaaatggaaactgtgtctcaataaaccctagtaccctttttctctcttattcttctatcttcctcctcctctatctttcgctcgagccattgagcaatt

SEQ ID NO: 5178 - DNA, 228 bp, Arabidopsis thaliana
agtaaaagacttatgaaaatcaacaaacaccatctgagtctgttagtttttagatcctaagttgggagagtctataggagctttaacaagaaaatatttatcaagatcatatacttgttgtgtaaatgatctcgagttccttaaaagttcgaaattgtgagttaactggatacattacatagttctttatccttttccatttatttcgttataaaatctattaaatga

SEQ ID NO: 5179 - DNA, 1671 bp, Arabidopsis thaliana
aaaagacaagtttattggctcttgtgtgtttgtaagatatttctaccatctctatattggtgtgtttctcgcttcagctagctactctgttcttggctctgcaacagttaaaccaatgtaccaaaaataagaagaaataatgtgtttgttatgtttatgtgttaagctactctgtatttgaatctttcttagccacatgtatcagaatatcagtgaacgtttaacattcatttgatataatgattcaaagtttatttaactagctattacctcttcttcaatttaaaaggttaattttcatcagcatcaagagtacacgataccaattttaaaattgctgattcatatatatggaatggagaaggagaagtaacaaaattgttgacttctacttgaatactatccaacatccatattaaattatatatatacatggataattctttcaataacatataaatttaaaagaagtctacttagtcaatgtgtatatatataaaagtatattgagatagctgtcattatgcgcagattcgtcatgccctccatcaccactggattatttgaatgtttacaacattttaaatgtcatagataatcaaagctcacaggacaggcacggtctcgatatgcaagatgtgaattagaccgaaaattctataccttcgacctaacatcatatgttttataacgcatatgatcggtctacttaatgactaaatggatcttgtataaacaaaaaatttcatttttttataatttgttgaattacatcgtagagcgtaaataattaacttatatgacaatcatgcactcatttaaaatgaaatgatttttctatacgtggtagtgtggtactaattaagtaattatattggctatatcatcaattgctcaactctacaaaatttcgttaaagatataaaaatatacattgatgacaaaaaaagaggtatacagtacagtatattcactctgcctatttcgtagccataggaatcgaaatgaaaatatccaatatttttggtattaaaggcaaagttaatacggaaacaatttgatttgacaatattctaccgaaaatttgaaaagtaaattctttcaaaggaatttctatttgtcttagtattctttttgtcacgtttcagaaagtttctatttctcaaaacgttttccaaaaatagaaatttcctgccatttaaatcaaaataaactaacgttgaaaaaggtttagatcttgaaacttctattcctcttcggtttaatgttttgcaccatcaacaaatagtccggtctgaaaagtttatggatgtaatctctataattcactagacaaaaagaaaaaattcttaagaaggaaacaaagtatcattttaatattacaaattttgtcaacgttctgactctaatcataggggataattgtatccggtacagggcgtttcacaaagaatcagctcctttggtcgccggcgatttagttattaacttatttacattgtatgtactttttgtagtacaacttcccaattactttaccgttgtacttgtcacagcaaatctccaacaagaaagtcaacactgtactacaaacaccaaaatatataaacattacactaataatgttcatgaagtgaagaaaaagcacaacacaaacaaacaataactaaa

SEQ ID NO: 5180 - DNA, 2000 bp, Arabidopsis thaliana
tagagatcattagagtggtcaatttacaagacaatgagaaaatgataaaggaaatggacgagaactagatagtaattacgtgtgaagaatatagagaatttggcagagaaataataaattgagtgaacaaaagtacacttcttaaaatttaaggaaagtctaggttttatatttttggaggatcttttatcatgttttataaactaaataacgttggtgaattgatcaaaaaaattatttttctttttagattgtttgaaggtggaaaaatatttcggtagtcaatgatttgattaaaataattggattgcggttccaaacttgagtttcgttgaaattattttttttactttttttgcactaaaagatagattatatatgaaattatataaaagtggcgattaacaagataattccataaactaagccgacggataacatgaaatcttctgaaactaaagcccaagaatatggggagcttaccaacactactgctaatggagttttgttggacttatatatcagagtttattggtacaatctacaataataacatctaatggagttttttttttttttttttgggtaaatgacatctaatggagtattgattatttaatattctaaacaaaaaaaaatcaattgaatatctcgtgaagttttttaagcacggtgtatttatttagaggtttcaagatgttctattttctttaatgtatatagattataaattaaaatactaatcaataactccccttagatcttagattttttcatataagtgataacggaaagctactttgggcttgataaaatacgaaaagttacgaggttaggccacatccacgaaaagctagaaagagaggcctgccaaggcctcgtccaaacttgtactactaatcaaattaattaaaatttctttattggtaactttttaatatattcatttggtcaaagctggcaggaaaaaagttttcaacttataattttcttatgaagaagatactgatacaatgcatattaaggtcaaagcaagagtctaacaatttattattcaaggaatataaataattgttaggtaggttcttattgaaatgaagcatttcacaccgtaataatgatatagctgtagaatatgaacaatgcgcgtttgcttgactgtttcgttgtaagtttgtaacaataatggccaccaagtaatctgtcactagaatattgcaacaaaataaaaaccataaatataactataatgatctactaatttattaatttaattaacatgaaaatatgacagcttttgccagcccttgctcgtataatcagtccagataacacattacaacgaaacatataaaataacttttttcaacagaaacgattataatatacatctaaaataattaacagttgaaaattttgatagacatactatatatgaatatgaacttaaataatgacccatttttcgtataatgttaattatttactcgtaaacgcgttatttccacgaaacattaggcaaaactcaagttaatttacgcctggcattgtaacgcggttaaccaaaaagcaaattacgcagagtcaaatcatatctaaaaaccaatataaacataacacgtgtcaatacttaactgatctcagaattaacatcgttaagagaaaacacgtggcagagatctgtgtatccgtttggtgctccttcatgtagatgattcttcaagaaaacttcaaaaactcaaacacgtcaagtttaagaaagaaaaaagacaacaattattttaaaccgccattgaaaagctaagccatgttgtatttttgtatgtggttcgcatgattagtgtcacaccaataattaattattaactatttcccaaccatcgcgtatatatagagctctcttctctcattgttctacaccatcaacaaaaataaagaagagtttataacattaaacagagagagtttcaagattcagacaaagaagagataatctaaaa

SEQ ID NO: 5181 - DNA, 1173 bp, Arabidopsis thaliana
atttactatatttttatgtagttcctacttctttggttgttgtttccttctgacacatgaacattaaagaaaactttggttaccaagacgcttaatttataattgattttatgagattgttattgattgagattaagtagagcagctaacactttgaccttttgacccacgatgtaatataaaagaacgttgaaaacgtgtaaatataaaagatgataacggtgatgcctttggaccgaactagtgtccgtctgaacgtcttgtaatgtaatgggcttaaagaattccggcccactaaaacaaagaagaagttcggtttcccaatagaacacgaacacgtgtcctcaccccatgatccacgatgcttcggaagacataaaaaatgtagccacgcgccttcttaaaaccttttccttttttggtttggcacattaccctctttcctgttaaagttgtctcgtctccttctcgtctccttcctcaagcatattctctggtaattcctctctctctgtctctctttgacttttctctcgcagagtttagattctttttttttctggatataaattatttacacgacacgaaaccttctaggtccaggtcatagttttactctatatctggatttgtttgaaaattgcttgtgttatgcgccagctttttccctaatatatagactaggtcttaattacagatattagagttcgtttcctcgagggtttctttcgacctcgtgtcctggtgaaattttggaattctaaggctttggggttttatttgggaggggatgatcatctaaaggatattcggtcggtgtcgtgttttcttaatctcaattctgttgactttagctttggtaattgaaaaagaatcttttcgcttgcttattttaattccatatccgtctcttattatatttggtcaattatgtgatctgatctttgtgaaattttatgaactgcagcgcttaaagtactttgatggcattgggacacttgtgcagcatccactgtttccttaaaatagggaaacaagaagagcttcttgtcctagatattggtttgcctattcccagtttcttcctcattaactttattggtagcagagcctcatccatctggtgaacttgtgaagcttcctctgtgattcttttggcgattggttagaaat

SEQ ID NO: 5182 - DNA, 544 bp, Arabidopsis thaliana
tgtcacaatgttgcttgagacccaagtaactttaggaatttgtttttcattattttttatggtttattgatttttttttgtagagagattggatattttctcccttgagtcaactagagaggttggatgtttgtccaatgaccttatttttctgaatttatttatttattttaaattgacttggtaataatgtagatttattaacaatttttttctaaaagattactttggatttattgttgcggtactaacttgtgttaatagcttgaatcaatattttatcacgaacatggatttattcccaattctatccaaattcacaacctaaaagatttgatttggttttctacaatttaaaagagaaggtgtttgcactaaaacagagtaattgatgaatcacataatttccggttcggttcggttataattatgtggtcggctaaaaaaccggaattttaaccctgtctccatcctcactcatataaatagtcgagaaaccctaaatttctgccaaaacctcacagccacacaaagaagagaagaa

SEQ ID NO: 5183 - DNA, 2000 bp, Arabidopsis thaliana
ttatttacattgtgctaaaatatctcttctagataagttttaaaacgagaatcatgagaaaaaaataatttataacaaaatttgttgatgatgttaggatgtagatcaatgttttataataatgatgttgtaaaaaaggcgataagtgtactttcaatcttgtttatcattaatatggcctttatcaaagtgtacactactaaaaaagacactgcaaaaacaatataatgagaacaagaacatttggaaattcagttcactataccttcttaatctgaagaatttgaaccactttaatagaacacttgtgatattaccttgaaatttataaatcaaagttaatatacagattattctttctttaatttgttaatggactatacaagtcaaagatttaccaagacatacatggctaattgtaattaacaatctcgagcacacaatctacttttgttataaattgccgcatctatttatgaagacaccatgaagcagtaaaactaaaatacatctacaacgacggacatttaaagatgtttttacttgatataataatcaccatgttaatacggaaattacatgatattgagttatagataaaaatctagtagatacatcctaattatatatagcataataaagctttaaattgaaatgttgacaaggagatgcatgaatttaaaggcataggccatagcttagttaccatttttgtaaacgaccgtcttcgcaaccacttctttttctcgttgacctgacaaaagcttcaaattatagttattgtggattgactttattttacatagtgtaggttttgtttatcatcacaaattattttaacaatcaccatctctaatcttttacgccattaatattaatattttcataatatattttagcagtcagatttataaattgtacctatttattttgttttaaacagtaggttaatgataataatattaacaatttacaaaaaattatgtattaaaataacatgattattttttttttgtcgtttttgttacgctgaaaaattacatacccaatttaaatctcacttccaaaagacataaaaggattgttttttactttgtgaaaattacatattgacagtcctattttgatgggcctaaaaatggcccaatagtaattagtttgggcagcagcatttcacctctgcgacggtcggagctcatcttcaatcataacttcatcttcttcaagcaaatcaactaaactctgatcaatccagaaggagcgaaagagaactatagatcggatgactaaattcccaacaaaccatagtttatccaaaattttccttggactaaaccggaatttccaccggttcagaattaaaccggtacggtacacccaattcagcaacaacaaacaaaaataaaccagaatctcccgatcaccgcactggttacattcccggcgccggaaaccgcctctactaccgcgtcgcagcgagtaagcatgtcttctgtcttcttcctcttatacttttcattagcgttgaaattaaggtttgaatatactcgaaataagattggataaatcttctgcaattcgaagaaattcaacgagagagagattgctgaaaaaaaactaacctaaaaagcacgtcacaaggccggcgagatatcttcaacaatggtcttcttctctttcgataaacaacaaataaaaaaattccaaaaggaagtaagaatagtcgtctctctgacttctctttaaaatgataagtcaaagtaaacaaattgatgccacggtgcttcctctttagcttgtgaatggtgtataataaaaactcttccttgctctgactttgtctttcccattttaccaagtctttctttttgtccccaccatagttgcaattcttgattttctctcaggttttgaatcttttgggtcatttggtctctcttctgctgttttcctctgaagattagagctttaccagagagataacttgttggagaagacaa

SEQ ID NO: 5184 - DNA, 2000 bp, Arabidopsis thaliana
taaaatttgaaaagatagaaaaaactattcaatgtaaataaatgtaagatatctttgaaaagaaaagataaactaaattttatagtagtactttgggcctttggggaatttaaatggaaagcaagatctacggtgtgatactttttattgtaaatattatagatatggcaaatgataaagttagaatcgagattttggaatcaaggcttggagatttaaagagctagccgcagttgggttattacttacatagtgaaatggtttcctaaacgaagatggctacaaatctttacatatctcaataataaatatagaatatcttcacattgattggtgcatcttcttgatcattctattatttctatatcacattcgtctgtctccacatcatcacttctcgtttcgtcttattgttgttatctttcgtgaatagagaagaaactcaagaatcaagatgaggtacttgaaaaattcttcctttactcttctaccaattttcatatagatctctctattgatatagtcttattgctcaatgtatctaacaattgagaaatgggtttgttcgttttatagtaagcttaatagtgatactcttagagaagccattgcaaatatcactcgcccatcggaggagaggaaactcaaaatgaggtacttgaaaggtctttcattaagatatctcttattgctattgttctagtttttgattcctatgctaagattgtcgtacatagatgtatcatatattgtccaatggattattgctagatctaatttacttagtgaaatgggtttgttggttatatagacaacttgagagtgagtctcttagagaagccattgcaactattgagggaaaatctgaggagaagaaacgtaacgttgggaagacagtgaagcttcaaagtgaggctcttagagaagccattgcaagtatcaatgaaaaatctaaagagaagaagccagaataatttgtgtgtccattacgttggaatgattcttaaatgttgtttctttggtttatacgtacgggagcttgaaactaatgggtctttttcatctctttaattagtcctatattattgaataactttatcatatacttctctgcaatcacagttttcaaagcgcttatgtggtgatttttctatccaactagggtattgtctttcgaaagttatatagaattgatcaaatcaaatctcatctatgtaaatacgtcaagtcaagagtttcaatatgagctaagttcatgtctttgttggattaaaactaatgcgaaatggcctataatttggattttaacaaacacaactgtgtttactttgcttaagattagtccaatccgaacacacactaattcccaaaaaaaaaaaaaaaaaaaaaaaaaaaaaaaaaactcttaacatacttaaataaaccttttcaaaataccacaatgtagaagatgggcttttttagtaatgatcacaagcggcccactaatataacaaaagcccatgaaacgaaatcaattcccctagggttttagtctcttccttccatttttcttcttccttgatataaaatcttcagccgcctctgaaacataactagggcttccgctttcttcaccattcaggtttgtctctctccacaaacatcgtcacttctcatttcgtcttcttcgttcatcgtaattccatgaagtttttcgatttctcctgcttaatctgaattctatgtcacaatcgaaaatgaggtttttttttttctttttctaatcgatctcttattgttttcaggatcagagattcgtgacctgagaagacactcaatatgaggtactgtgaaaaaaatcattcctttacgcttctttcaatctccatattgatctatgttcacttgctttagaattagtgttgcctttagattgatagcttggagagtaattgctcaacagaatcatatcatttcaaatgaatggtaaagtagattgctttacctgatttggtgaa

SEQ ID NO: 5185 - DNA, 356 bp, Arabidopsis thaliana
gaatcaaaaccaaaaatcgaagaagcgagcgagaatccgaaagcaatcgaagaaaggattttgaaagaaccttccaaaaatgagaaagggtttttacaaggacgacgaagaaggaggattttaccgctttctgcgtatccgtgtcttcctcggaacaaaatcttctgcctcccaaaaatttagcagagttgaatttagaaaactccaaattgggcccaataattaatcagcccatataaataaaggccttaagagcccattatataggcttttgattgttgttcttcttcttcttctattacaacaaaaacccttcgacagaagagaaaaccctagctagaaacgacgatccaaag

SEQ ID NO: 5186 - DNA, 1129 bp, Arabidopsis thaliana
gcctaaggatcttgttatctcactacagaagtagtagtatatacttgtaaattcatgaacatttaaagcttaagattttgatatctcactctattttcttaagcatgtgatctcataaagccccaatattgcgttgacacgtcatcattttcggtataatattgttattaagcgtcgcaaagataaaaatatgctttttgatgacttctctggcattctcttctctgcattttataagatcatgttgatggaaagtcttcgactttggttacaagcgtcgatgcccagttggttagatttggatttctccgctatactttgtttctttgtaattaaaaaccatgttgcttcgaactttggaacgtttgggttatgcactgaatgtgttcgatgaaatgcgtgaacgagaatttaaaattcaaagttttgggcagtgggggcccaatgtttgaagccgcccatgaaaagtcatacctccactataggaaatcggagctagaactctgcactcttcttcaggtaagcttctcctaaatccaaagtctgttgctttcgatttcatatcagggtaacattctttcccaatgaattgaaaagttcttgtgttggtatttattccccaaatttgattaatctacagaggaaatagaacttttagctgcaagtaaaatgttgcaaaaacgttcttgtgctctgttactttctagaaaatggagaaagttttagctgcaagtaaaatgttttgcttttgtctttctgttactttcctagaaaatgtgttggctttatttatggttaaggcccagagatgggaatatacaaagttatcttctaaagcaacatggaatataaaactagtaaaacatttagttttttgacttctaatttggtgtcaccgtgtgattttgtgaatggaaagatgtgactctagtggtcaacgaggtctatgatttttctttccttttttatattgcggtcacgatggctttactagttattataataatataagttaggagtctccatagatataccatccaagaggtttcatattttatttgttctgttattgcattgactttataaagattcatacattcaaatccttagaagagctcttgcatatcgt

SEQ ID NO: 5187 - DNA, 2000 bp, Arabidopsis thaliana
tatagctaaagaaagtgtatttattaacatatataaaaagttggttttagggtaagactaatgcctcgaatttactagttgtaacattttattctttttaaagagaatatgtgtctcgaatttactaggcgggtgtaattggttgtagaaaaacgttattgttaaagatggctttgatcagtgcaaagtgcaaacaagtgacgtacgtaaaatagatgtaaacaataccaattaaaacataagtagttatttgaaaagaaaactcttaacataaagaagattatagaccactaatttgtatttcaaactatataatcatttgtcctttgttataatctacttgtctaatgtctaatatgtaatggaagaaatggtctgtcttcactcgaaccgtttccaactgatagtattaattaaattcaatatccaatgtaccgataaattaacagaaacatccatgaaagtcttggtcacaaaaaatatatttcatgcacttaaaagagatttggtgaagaaatctcaaaacagtcttattacaatcaaaatttatctatcgtatataataaataaacaaaaaaatcggtgagattagaatattgaactggaaaagaaaaaagaaaaaccaaagtcaaaggaaacgacagcttccaagtaaaacactattagaagattaagtgagaccaaactccaaccttcctcacatattttggataagcttcgcatctatattcctcctacttccatgtgccattcctttttcaattcataacacggcaccgtctaaatgcttatccacactacaataaaaaatagtcatttttattatatacgcgtttcaaatactgataacacgatacagtactaatttaggggacactatatttgtgaaaactgcggactatacacttttctagtatccaaatttaattttgagcaataattttatcgtaacgtatatttgtcttataatgctcctacttgcaagtattatcctaattgtttgaccttatagatagagcttttataacttttgtagggaaacatcaaacatgtattaaaatctctagtgttgcgaatttaagtttatgctttcttgagtttctttaattgcccgtcattacgctactaaaatttcacaattttgtccgttttatacataaatatacataaacaaatacgtgatttttctctctttttctattcaattcattatagaaaataaatgacgtttttcatatttgcaactaaaacattgttttctttcagttttatgtggtacatgacacctgttatgttttacgattgttgatatatattcaaaacaccatgtgcatgattagttgaacttgtagctgtagatcgacaactatcaaaattattatatatttgcttcgatcaaaaactatctacagcttgtaaatattgctcataagtgacaacccataacgcatgactgactttcaaaaatgtatttgcagaaaattttatattcttatcgatcaacccctaaatgttatactacatcgcatatatcatcaaataaaacatttctatatatgtattaacatgttatgaacatgactgtgtgttttaactttaacttttattaaaagataatatcttaccaaaaacgagaaaatattcgatatttccttagaaatcagattactgaacattcgactaatcatcaggcatttacctttcatagaaaacagttcaaaaagcaatataaagccaaaaaacgaaaaaaagattatcctgaaattaatccacagtactggttttttttttttttaaaaaggagaccgcgtttctacgctgactttcaaatcagtcgcgtcggtattattccacacgccttttttctcgtccccatcctctatccacatttctctctatatatactctcctcgtatcctaaactcatcctcaaattcaaaatttaacacacaaacacaaacacacacaccaaaaaaaacacagaccttaaaaaaataaaa

SEQ ID NO: 5188 - DNA, 2000 bp, Arabidopsis thaliana
agggtcattcgattatatatactagtaaaaataatatgaacctctcaataatatatgtataagattatgtgaagttattgggtcggcagtcggcacctaacgggagtgagatcaaatggatgtaatcatgtaaacttatgtgcagaaaagaaaataatgtaaacctatgaatgagtagattattagtattgtttagtgtttcttggagatgtaagggttctcacatccacattctacttcatcttcctcaaatcctctgcaattgttttgttccctttcttaaaacgatttgggaatgttcttaggatattgaatgtaaagtaaaaagatttgtccctagtctgaaatctattcattttcatgatattgtgtgaatgagaaccaccacaatacataactgaagttttaataaattacatgcaaaaaatttaaataactatttatgtaatagttatatatctctctattcattatttgtgttcataaacaaaccaagtcatgtggaaatatgaaataattgtcttgatgacatatttaatcaaacaattccttaacccaacccatttccaatcatatcaactagcatttttgtaaactcgcaaactttgtgaccgttatgtactctcttcggattcacggtttcactcgaccgttgtctactttactgtatactctctttgggaattttttagtcttaaggttaactatcaattgctttaggatcatgcatttttttgtctttttgttagtttgaatggatgaaaattcccttaaaacattatatttataggattgaattgctacttaagctatcttcctaaccgcatgcatgaattcaatggatttgataatcgtttatcttgaaatcttgatccattatatctaaacaattgcttaacccactttgacatctttaatctgaaaccgcttaggaaaaatatgctatatagaattaatatagctgattgtctcaattcatctaacttaacttagcaattagagaattaatctagctgactatctcaattcatccaatacaatcttagaatgatcaatttatatgagtttatctttcgtatcattacaatcattttggttatcaaaccatcattttggtcgtacctttatccactcattgaaaaatataaaaatatttggctccgattagtaatacgcgtaattgcaaaatgacatttttttaatacgagtatataagaatgttaccaattaagaaaattaacataatatttattaaaacgcaaaaatacagaatttttgttttcttcatagaaaataaaaataaaaattcattatgtaaatacatattatatgtatatttaattttagacacatatatttgtttgttttattatgcaatttttcattctacaaatttatagttttgcaaatttttattctcctacttatgtcattaaaaggattatacggggttatctcagaacttgtgatttcaaatcttgaaaacacgttttacgtagtcaatatttatgtaagttaattaataaataaatgcactaagagaatcaaaatcttataacaaagacaaccttacatgacgtttcttttctgtttggcgcttacaaaaacatcctactataaccaatagttatttaaaccactaaaccctaatttaacctataatatcgatttaggtcggttaagctattatttacctcactcatactaacgaaatacctaaattccggtaagttatttaaaccggataaaaatcgacaccttccagatctagatccagatcgaatctcacgtattttgtctatgcccagtcccaaaggcaggctgtcacaacttggcggaccccaaccaattatcaaatctcattcaataaataatcaatttcccacaaaaatcatggaaattaggaaaaaaagaagatctcgctcaccgctctcatttcctcaattctccgtccgtcgaagaagcgaatcgctcgaaattagggtttctactgagagaag

SEQ ID NO: 5189 - DNA, 2000 bp, Arabidopsis thaliana
aaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaaatgagaaacaagaatggtaaaagaggtagcgttgagccctcggcgaggaccgtggcgtcggtggttgctaatgggaggtttgaaggaagatcaccatcgagcgacacatcatcatcacaaaactcgtgcctgacgaggacggaggaagtgaaggaggaggttgcatcgtcgtgggttgatgaagaagaggcgccggagatggtggtgatgggatgtcgaagttgtatgatgtatgttatggtcttacaagaacgtcaacgttgccccaagtgcaaatgcaccgacttgatcttcttttagagaatttgttttaagttattattcaatttggacttttgagtttgagatgatgaatttaattttctttgtaaagtcctctatataaatcatattgtttaaattataatctctattttaatatgttaaattgacagacagatcatttctgtttgtggccgtccctcttggttcattttgttaagttgtccattttcatgttttagtactatggaagccaatgacatgaacgaggatggattttcatcggagttgaattcgattgtttcaaacgctagttatggcgtttgcgtttatatttatttatttgtatactccagagaaacatagtttttcaatgtaaatgaaaaacgccaaaaaaaatagaaagtttatttttaaaaattacaaaatataaatttaaacacaagtaaaaaaatcgacacgtctcgaattagggtcttaagaatcaaattggtagtatgctaataatggtattgctttggtttcatcggcattcaatccgatgaaattttcaataattaaggttaaaagttgtatcttcatcaattaaaacgttatttattcaaaacaattcaccatcaaattcaataaaatttaagaacttttacaaacttcaaatattaaattatttaagaaaatatttttaaacctaaatttagtgaaaaagtagcaactaaaatttgttttaatgtattttatgacatttttctatttataagtactaaattttcaaaaatctaataaataattaatttctgtttttcatatatattaaggcacatgcgacgacatatatacgtgacaacattttatcctaaagttttaacatgatttttgaaaaagaaatttacattttacgataatttagttgcaaatcaagcgagttttaatatttcaataattttcatgtatatagaaattttgcattgctagttaaaataataacaaatagatgttgtcaaaactcgaaaataaaaggggtgtttctgtagttatcataatttaaggaattatatgatagaaaaacaaatttgggcggtaaatttgaaaaaaataactttttccagtctccccaaaagtacccgatttgccaaatttgaccctcccattttagctttctgtctattcaccagattctctctattcgattctccctttacttcttctcgtctctcttctctgctcgtcagatctcaaaatcaatcggatatcgaaaccacaacttcatcaatt

SEQ ID NO: 5190 - DNA, 2000 bp, Arabidopsis thaliana
taaatactcaggactacaagttttttttttttttttttaactcgactacaagtttgttatgttttgattgtacatatagaatttgattggtgatttaaaaccataagaaaaaatttagcagtaaaaaaacacggtaaatgggtataaagcaaataagtaaaaaacaaaattaagagtatagtttaaaatttgatgggttaaaaattcatagaacaccgtgttgggttctctaaaacaattggatgtcaaaactagttaaaaattgcaaagaagtggagagatctagattattggtggcatttggtttatgttggatcgatatttataaactttttagtggagatatgagttgcgaatatgtttcgaaacatacacaactattcaaacttgtatatagcttgaccattaccgatcaagataaaagttttttgagatccgggattaaggatataaaacgtagaaattcctttaaagtatctccaagtaattgtttatattacaatacaagttaaagaatggggatgttcatgcgcaccttgtgaagatattataatgttactaatagatcaaaaataaaatattacagctttcattcaatgaataagtaaaccaaaattaaataaaaaaatctatattttgaaattacaattaattggtttgtagatcatgatatattgtttagtagtttgtggcattgtgctattatcattaacaagataaccatccggattcaaactcacataatatacgtttaaccattacactttcctctgtcaatcactcgaaactatctcatccgtaatcatttttaaccgatatatcaaatcaaagaaattgcctactaacattttttttttgtcaaccaaaattaattagagcttaaatgttgtttacatatatgatgtgatgcggttagacacgaatttttcgtgctaaattatcggttttaacatttgcactacgagaaattaaagataaagaaaaacttgtgacaaatctgcctagtaacatttaaaatgcatccattgtgattacaacaaccaaattttatgtggacttgtagattagaaaaaaataaatttgaaagtcattgaaaattgttgaaaaatgtatttataaatttaaacaaataataatgcaacaataaatgataaacaaagaaaataataaaacaacaattaatgattgagaaagacactaaaacccccactaatcatatacatataggtaaaagaaacaaaatcaagaagagtgtttatggttaaacaaagcaaaaatgatcaaataaaaacaagattatgatgttgttgttgtaaaacggcatagtcaagtcacaagcgcaccaccagacggtgccgcaacaacaacaacaacaacacctacaccgcataagttacattacaacacaccctgtctttaaaaactctttcctttttaataataaatctttctttaaataccatctctcttcttcctcctctgcttctcttcatcttctaagaaagaaacaaagaaagacttcacattttaccattatttgctctgagctcaggtcagcttttctctcttcccctctctcctctctcttctactttatggtacagttgaattaacaatgccattgaactactacttccatgaatgtatcttctttacacttgttgtcttaagtttctatttttgtctgatccagatctagtttcttctcttgtgtcttgtgaacactttagcttcttactgtctttatgtttgttgttgttgtgtcggtttgtttttcatttttccagtaatgttgaagaaacaagttcaagatctgacttaactaacttacactagttttagtttgctagtagctatataattctttgatcctgttaaagaactcaaagatcattcgttcttgaaaacagatccggatctgagatagggttcttgataaagattcgatatttgaatcctgatttggtttcttgtaatgcagtaggagagttcaagaaaca

SEQ ID NO: 5191 - DNA, 2000 bp, Arabidopsis thaliana
caatataacatgtaacaaatggatagagatgaaattaaaaaaaacggatccgtaaaaacggccgtcaagatgaaggaagcagactcggtccctaccgttttagatctaataataataggacacgtgttcaaatctcatgaattttagtagagaccacaaaagttccaaccgcgtatagttattgaaagctatattgtgggacccattaacacgtggatccatcacgtgctgtcagtttgagtttcctgaaggatacaaatgaatatattcttttctttttaatacagttgatagaaagaggccgttaatgacggcgttaagcaatgtaacgggaatctctttgaatgatttgacgtcgacggacgccggctgttatgcttaaaaacgggttttcttgtcacaccattttttttgcctttaattaattgtatttcgagctatgaatgcttagtaatattacactattaggttttgtttgcttgatgatttttttatatagtcggaactttaatattgtcatcaaatatcattaaatttaatgttttcattcgtgttttatttagtttttgttgttttcgtaagttttaagtggctagttatattttttatttagactttgacagtaacagtagattagcataagcctaagttaactttgtcaagttaaaaagatcgaagatacaacatctgaaatctcgatatatatttattattattatgaaagcttttaaaattatatgcatcttggaaattagaagaaaaaatatgacctaattaacgtttaatacttgaaagttacttctataaaagagaactcgaaaattgaaaatacattggtccgatgatttttcaatacccaattatagaatcccttttagagatttttttttgtacataaactgaacctgtaggacttaaagttactgtaaaattactagtactgtacttttgttaaaaccaaaatttactattcttttatctgatcatacgcaattttagatttatgttttcgatggctgagcttcaaacaacttgttggaaaaaataaaataataatctcttacaattcaaaatgtgattatatatcattatttttttacatccaagacatatggttaaattattattaccataaagaaactgggaagtaaaacagtatcatgctatcatgaagtgagttcagctttttaagttgaatttaattatcctctgaaaaagagcatcttcagttcttccatcaaaagaatcaactaaaaagccctaaatctcctattttatagatttgacaaaagtttaatgattctcttagacttgtaattactttcttcatcaattaaactaaaattattatatagttaaaaaaacaaactcataatatatctattcagtagatccacaattttttatattactccatcagatcttgtaaatcaaaacaaaaaaatacacatcacaatgaatgtaaatatcacttcaaatatacagaaattctaaatgtttttacacactttatttttttttacgtatatgaaaataaaaataaaattagtaatgtgtgttgtaatttcacagccttatcactttagatgtgtatgtatgttactctttctggtacattattcattggtcgtcgagccccatcaccaccattctttttcttttctttttttaattttcatccagaataaatatctttttattttaataaatttatattttctggtaaataaaataaatattttttgagaaatttttttattattattttgagaaattattattattagttctggtatgaatgatgattgaagtggtagtagcagtgaaaaacaaaagcaatccaatcccaaacccatttgctcttaagattcttcacatagagaagtcacatgttccttcttcttcttccttcatcatccccaaacacacacaaactaaaaaaaaggcaaaaccctagatccaagatcagacctaatctaatcgaaactcatagctgaaaa

SEQ ID NO: 5192 - DNA, 1004 bp, Arabidopsis thaliana
tgctgcttgcttcagttggattcagttttccctcgcctctccctcactttccttacttcttaatcttaactaataaggcccattagagaagacccactaggacttaatgggcttttagcgggaaaataataaggcctaacaagtttttaggggtcccttctctttaatttcatcgacattatttgaaacagacagtgaaagaagaaacaaattgtggattcgtcgtctgcgaaagcatctgggagagaagaagccacagtcattttcttaaacgtgttcatttttcgtctaatcaaatcatggcgcatgttctgttctactacaatcgtaagtttactgggttttatctatttattgtttattcattttacattgaaacatgtctgaattattgtactggaaaaattgatgtgaggggtgtaataaattcgtttgattatgaagaaaatttgtgaaagaagagggaatgatgaacaagagtgcacgtattaagaggaaacagagttgtgtggtccttgaccttgagggtgaaaaagggtccatgtgagtttgattattgatagcgatgtctatcctcccaggcttccgcatcgctcatttgcagcctcagaaacatgattgtctttttaaaataactcaaataataatataactgggttttggaaacagtacagttgtgttttttaattggtctatctctctatctttctcatcgtctttgctccttttaaagactgtgtactatatttccatgagttgcagctgataaagctactctggttggtatatatatatttttcatttattttatctacttcaccttctttaacgtgttttgttgatttgcttctaaagacttttaatggcatttattactttgtttctcgaacctacagttgtgtctgcctcttctttctatctaacttgtctatgtggtgtctggttttgatttgcagactattcattactctgtttcgccataagaaagagaataaagaaacgtt

SEQ ID NO: 5193 - DNA, 1905 bp, Arabidopsis thaliana
tttctattttgtactaagaaaattttgaaagagaaaaataattaggggtttttgttaggcttttaaccatatagttttgctgattaatttatttttcctcgtaatctcatttattaagttccaaatctcaatttattccattgtaatccgtgaaatatttcgccaaagccagttggtttagtaccgaggaagaaaatatataggaaactatattttagtcttctgaaaaacttatgttattagtgagaacttatgttattagtgagaacttatgtcattagtgagaacttatgttattgctccaacaatatgtaaaaaagcagaaagtgtcattgtaatttaagtctaatggtaattgctaaaatcctcctcaactgaaatttcattctactcttgctctatattgcaactatcttaaatttaaggcaggtcttgatcatgtatagacaaggttttctggtttaggtcacttgtgtagaatctaaatagtctagtgttgaagtctttataacctattttaaaattttactttttgaagtaaaatttgtttgttgaaccgaagaagatgattcataaatcagaatcacaatcttgaaggccatatatagaggctaaataagatggtggagccatccattactgcagttctttcttagcttacaaacttatactaaatcgactagtctttaacattatttttttgtttctctttttcaattaccggtaagcgattagccattacgtggatcatatagtaacttatataatatgattacatctttacttgattcaaaatgtctctactacaacaaattctatatttgcaagctaaggattacaaatttgatatcagtttgttgctaaattttgaaaactcaatgtgttgctaaattttgaaaactcagtgtgttgctaaattttgaaggttcagtgtgttgctaaattttgaaaactcagtgtgttgctagattttgaaggttcagtgtgttgctaaattttgaaaactcagtgtgttgctaaattttgaagattctgcatgacaaaactttaaagatatttctgagaaaacaaagtgaaacgctctgacattggataattcattgtgtctctttgtgcaaaccgaatatagaactacgacaagatgacttcatcaccgttatgtctgaataataaagtactaaagagtgtctaaatgcgtgcgaattaaagtatgagtgcgtccaaattatgggtttcgtaccaaaggcccaatatcaaagaatgtgtatcttttagtgggaataataaaacgacaaaaaacaaggataaattcacaacaaaaaaatggagatgcggggtatcgatccccgtgcctctcgcatgctaagcgagcgctctaccatctgagctacatccccatttgctcttctatatgaaatttgaagtatataatatctcatgtaaggagagaatcattcttatggattcaagatgattttagtttggtaggacctatagattcaagatcgtgttcatatcttcactatccactcttgaatccctgatgtcaagatcccaataaatccatcattcgggtattaaatttctacctaatattaaaatttgttttttttgttttggtatatactaaagaagacccttaacgtcaccacattatctatcacagaaaattgtattaatatattctctttgtttctataccaagcaaaatattttactattttacattatacactaaataagacccaccattgttgatcaaattgactatacttatcttgagccgccggattcaattattataactccaacatcaatctcactatatattatacttgtctctataattcaacaattcaagctttatctctttctttctctcctctctatctttctctcacactc

SEQ ID NO: 5194 - DNA, 1339 bp, Arabidopsis thaliana
ctgcttctgtttttcaatatatttctagttgcaactttaaatttaatgtatcgactggtgactcgtgatgttataactagaaatagctgcttatttggcaaattttggtttagtcatatttggtattgttttgtttagctttatgtgccttcttatgcacacatctctttccttaattattttaaatcgatgtttaggaagcattctaaaagacaaactattaatattaactgctaaaagtatattcctgtaaattctacaactgtatcaattgactcactgatgatgacactattttacttgaagtagttaaaattaattttgaaaatcaaatagttttggtattcttcttggtcttctcgtttgactttgtctacattgttattaggtttttatgctgattttagaattagctgttactggcaatttcatcttcttcctttttaatgagaaaaaaactcttctttcatacaaagaatgctttgccgttgtttagaagaagaagcaacagagaatctcgaaagaaaaatgaatgaagaaacgtataaataaataaattgaacttttatgatatgagagactaaaaagcgagattcagagattgaaatcaacggctgagatcactttcctttttgttttgatctctctctctctctctctctctcacttcgaattccgtccgcctctccatgtttgagttttgaatacctctctctctctctctcattctctctctctctctctctctctctctctctctctctctctctctctcgacttcgatttcgatttgtgttcttcttcttcttcatctggattctcagcgtcttaattacttcagattaattttggaattcgttgatctgcaaggtgtgagctttactcgtatgacctcgtctccttctcttattatggtcacatttttgttagttttcacggagacttcttcctgatttttcaaaaatctactctttgaacttctcttactttttttcgtataaagtttcgattttcttcagatgatgttcgaagcttttttctcgaggtttttgttttgggttctgaaactaattcgggcttcttatcttaggtttttttggatccaatctcaatatctaaagctaccttcttcattctgtgaacttcttccttgttttgactttagtttgctcttttgctgtgaagctaatgctgattcttagtctgagtccgactgtgtttttaattttatggtttatctttgtttcaaattacagcaatgtgcttcgcttatgatgatttctaagacatatcaaagaaacggactttggggtttttcatattgctttccttgctaact

SEQ ID NO: 5195 - DNA, 2000 bp, Arabidopsis thaliana
tacaaaatttacacaagtaatgtcatgcttctaaagtctaggactactgcatgctaaactattcgttttaaaatttaaaatacatcaaatgaaagaaattagattgaataaaaaaatcaaatataaccgagcttccagagtttctctaagtaaattgagaacgcaagccatgaccaatctggtgaatatgaaaaaaactcaaatatttatcatttacatacaatgcacactagatacatatgaagattttaactagtttagtataagataaaaaacacaattttccatgattatttcattaaaaatcttaaaatttgctaaaaacaatcctgatactttgcattattatcattcatattacgttgttttacttttcaaggaactgttttatctaaacatgtataaggttatcaaatgattaacgtcaaatctgaaacaataatgtaaccaatatggaatttcgccataacgtggatacttggcagtggttacttggcttttcctttattttcttttggacggaagcggtggttactttgtcacacatttaaaaaaacacgtgtttctcacttttttctattcccgtcacaaacaattttaagaaagatcgatctatcgtgatctttctatcaaacaaaagaaaaaaggtcttcatagtaacgctacaacatcaaatatgtggttgctctgacatcagtcgggaaaataaggatatggcgccattggccacatctattggggtcccaacttcctttcacaaaaaaattaaattgggtgtcccaacttttatctttgatatagtgacatgagtatcgggagcattggacaatggataaaatgagaactaaaaaaattctggttaatttttgatcattgttatttaaaaggttattttatctataatctacccatattgatcagttttatttaaatttgtttagctaccgctcctcgagagagatcctcatcttaaaaatggaatatggaaattacacacgaccccaaaagtatattttttctctggagaatgctatttagagctttgactatatggtctgaattagaaagacgggaaataaaatctgctaagtgatataagctctaagtaggcgatgtgtgatggagaacaccttttctttaacagtcttcatgttttacagattcgcgaacttcgaatatccctatacggtctgtctaaccctcgtgtgtcttttgagtccaagataaaggccattattgagtaacatagacatgctggaatccaaccattgaagtcacaactgtccatgtagattctttggagaatctgaaaagtcttaataaaggtggtgtttcaaagaaaacaaaacaattgagttaagaaaaaaaaatatcatgtagtggtcgagtattatgttatttattgtgtagctaccaatctttattctttaaatctgacataaaatgctacaaactttttacctcgtctatagccccaaaaaacctaaccacggttctaaaaccacacacagtgattttggttgacgacaatgcctctccttcctcaaaacgatttatttacattttttaaatcaaatgttacattttataccataattaagtctttttacagaatacttagatggaagagatgtataaaaaaggaggaaattgtaaaaaacatatttcgatcaattaaaccaggattcataaaaatataagtatatatataaatgatgtttcgtttagcgatgaacttcactcatatgataatacttaacaatataagtacataaaaaataaaataaaattaattgtttacgaaaagtctacaaatactgcatgtataattaatgttctctttatttatttatttataccttaccaagatatatctataaccgcatagaaatagaaggcgaagagataatttccaaaaacaagaaaaacctctaagctcaaaagatgttgttgagaacgatggcggcgacttccccgcggccaccaccgtcaacatccct

SEQ ID NO: 5196 - DNA, 1662 bp, Arabidopsis thaliana
tgaggcgcctcggtcgtaacttccgcctacttcctacattatgttaactcaatttttaagtgtaattaattactaatcactattcagtttttgttttgttaacatgatttctcgttttttttttttgttgaataatttttagattcatcctcgtaaaatggtttaactaatggagtcattttaaacagtaaaattaattatttctagaaataaagaagaacatgcatagttatttaagttttaataaatttattatcagtggttcaatgtaccagccatctcgaattcttaggaggacatgtctcctgatagaaaaatattttaattaaaatctaccaacaagattgcattggtgcaattaatatctaatgattatgattccatgttgtataatctcattgcatagatattgattcgaaatagaattttcaaatcacgaaaatatgaaaatggataaccttgtcagttgtttcatgagtcatgaccctctcatctatgtttcgtttaacttaatttaagaacacaatttttttctcatgcacaaataattagtttaagagtttaatgcgtagggtaatccaacaccaagagtgaattttctcttcttagcttaaacaaattatacatcataaaaaatagctaatctcagttttataaaaatttcaaactaattttttattattgtactttaaaatccttaacaattttcaaaaccgtaaaatgaaaccacattcaactaaaaattggattatttacacaaacatagaacatttagtaaaactctgaatgataacatacagtttaactgcacataaagtgcgatgcagttctaataataacaaaaaatatatatagattttttgttactattacaaccgtaccgcatgatgcggttctgtctctattcgtagcctagagatcagtcgatttcatattttaaaatttggatttcagattcgtcgaatatgaccaaaatgaacgtgaccctacaatcattttttacggacctactactaaatctatactaatactcaaactttatagcctagacataacaaaaacataacacgaagattcatacacaacgagtgtataatataatcttactaattagtgcttagatgcggctccctacttaattacagtaattaaatttgcttttgagggaacatcgcaagatcgagagtttaaaaagttgcttaaaaaaactttcccattaaacgacgaaacatcgaactttctctttatcttcttcattcacctgaagaaagcaaatttaaagaatacgaaagaaagaaacatcttcttcttcttcttcttctctctcggacactaatcggatcggatctaacaaaactcgtcaaagagaaagaaaatattttcataaaccactgatttgtctatgatcaggttatagtttctttccttcttcttcctctatgtttctgcaacttttaccggaacttcaaaattttgcgggaaaaaaaaatcgaaactttttctttctctctacgttgtctcggcggttacttgaaattgattcgttgattgagtttaagtaaccctaatcattgctgggtttcacttttttcgatttctttattcgggtttgaagttaacttttaaaaacctttctttcaggaattttgtcgaacaccttca

SEQ ID NO: 5197 - DNA, 2000 bp, Arabidopsis thaliana
attagaccaattcatagttttcttcttatacttaatcgtctcgcttttcttttaatatatgttttctggactaaagtttcttacaaattttgtctttggtatctaataatcgtctctctattctgcttcccaaaaatacacttcctttcacgtactaataaaacgtgacatttagttttcttaatagatgtcacatactatataatatataccgaaagtcaaactagcgaaagagtttcttcatactttacattgatgaaaattataaatactctaaatggattttgtattaatgttgatatttcgtgatatttaaattttatatgaatgttgatccaaaaacccattttaccaaaccaccataaaactcattctgccatataacatgttaagtcatgtaacttatcttgccatataatccgtcatgcaatatagtctgtcttatgctttttttttatatatttttaaattttccataatattataaatttttgttaattttaatccaccctatattgaaacagcgagttgataattttttaatttattaatgttgatccaaaataagtctcgctaggccatcataaaatctcgtcccatgttactttttattttaaaatgtttaattgttcataatattataaactttctatgctctcaaatatatcgattataataattcgtgtaaaattaaagaatttaactaaaaaccgaattaatatgtatacaaactttttaatttggatgtttgttaagtgaaggtttccagctcgtttagatttatattcattttgatcttatttataatataactctgaatcattatctaaacattttaaccgatgtgggacattaaacacatattttttcattaattgggtaatatatgtctgttttaaaatttttaaattacaatatatgtagaaaaaaattgagatttttttaactctatgtattataaattattcaaaggagttaaaaaataatcaaacaaagatggaaaaggaatcttaaatctaaatcattaatttgaaatatcgaagcataattagtggacacagtccaattttggtaatattggtattcgacttttaggaaaaaaaactggtgggagatccatgttaaatataacctgacccaaataaatttttatgaataatttttcttaaagaatcagataccatttgtatctaaaattattttaacccttcagccaaaaaatgacttcaaaaatactatagagataataaatgaataattattgggttcatccataagattaacctttttattcacctcattttattccatctaattattaaacttatttaattataaaatccaaacttttactacttttttataaactcaaaccgatatataatctcgttgtaattacataatctaaattttaattctcttttgtaaactcaaacagatattcaacctcgtttattgtaaaatataaactctaaccattcattctaaatccgaaccgatatataatctcggttaattataaaatttaacccttttataaacctaaaccgatatttaatcacgtttaattgtaaaatctaaatccttttataaattaaatctaaactttttaatgtcggtttgaatttataaacgggattataactaaaaaaaattctgttatgtttttagtcataaaatgttaatttgtttatgattatttttgcaaccatttgttttgtgtttataattgttttcaaccgaatgaaaatgaatttccaccagacttataccggacgaaaagagtcttttaatttcaattttttaattggagatgcaaaatcctcgttttctcatgtcagttgtcgacgggaacaaaaactgaactccgcttctaagatccttcgacggagagaaagatatttcagatctgatcggagagaatcattctcaaaatttctccattctaatttctctttctcgagagagtgaagagagacaacaaggaaggaagaggaaaa

SEQ ID NO: 5198 - DNA, 2000 bp, Arabidopsis thaliana
atttgcttatccctgctttttaattgtagggatatgtttattaatcctgttgagccagcttctgatctcatggtacatcatgttgttaatgctcaccaaggacttctcagtgaagaagatgtaagagagcttaaactagttttatttcttctttttggtagtataagactataagttatgtctctatttttcaggactgctttatattgtataactctcttttcagattttgcagacaagagccacatcatctctccaggagtccttaaacctacatgaagaaactttcacattacacatttaggccaatccaagaacaagactttcttggtgtaagattttggacagagtgcgtgatgacgtgtagaaacagagcattatgcaaaatgtatttgtgatacttttgtcatatttgaacaaatgttacaattttaacattgttactaagatagtaagatgtcaaatttgggatacatgtattgatattctataattctatatagcataataatccgacagctccagcgtctctttctccgtcaactgctccggcaatcacatgccattagttgaaagtttctttattacttccataattccatttatatttgttgctgattttgtttttttagtgtatttttacttcaaacatatattatccgaatcttctaagcatgccattttttttgtttcttttagttattttacgctgaatgtcacaatttatctttaagtagttttaggttaaagaccattttttaacccaacaaagtataaaatcatcgcccaaatcgtaatctagattttggtaagaatagtttggttggtaagagttacatatataacaaaataatcaagcataaatataacttggcaaatataacatataattttaaaaaatgagctcatatatatagactttctgtaattttgtttataatgattaacgatatgattgaattagtttcaataatgtgtgagatagttaatcacatgatttcttagggtcaacatctagttaatcacatgttttccttgggtcaacatctagttaatcacatgacatgtgatatattttgtgtgcgatttcgtcatgtacacatatatatttacccctttttatacattttaaaacatattttaaaaattcacaactaacggtataataaccgttaaaaaaaggcttatagatatggctaattaattacattggccgtgacgtgtatataatcgaacgattgcaaagattgctcaagtccagaattgtatatcttggattttacttagagaatcttgattgtaaaagtgttcctaatattttcaaaacagaaataaggaaatgctgtaatgatgcattccatgatcattctatagtaccttcgtgtagaaaaaaagatgtacactaggataaatatttattaatttaattttgttacttcttacattttaaagaatttcttgctttctttgtaattcttttaagagttcgtattttatcgataaattgatgctatgacactaaagcaatagaacattttatccataacaggtttttgggtctgcagttgattttctatttatgtttcataagtcaccgttgagtaaattttggacgcgcttcaagaaaaaataaaaataaaaatagaaatagaaataattcatatatacaaatatatgataaatatgtgcaaaaatgtcattgttgataccacgtcctttgctcctagaaattcgatatcaaccatgtgtcccaatgattaattggaaatgttaagctctttttatctatcatgaaaaaaaaatacacaaaccccttatcatataaatcgcacatgtattgttttttttttttttgataaaaacgtaacgcacatgtacttaattgtaccatagactccaataacgaaccaatcatgctctctctcgctttatatagatatatacccatgcatgatgcatcaaaatcaattcaaacacaaactcaaactcacatataagaa

SEQ ID NO: 5199 - DNA, 1039 bp, Arabidopsis thaliana
tttttttgctccaaaataatagtactctgcagaatccgtagaagaaggaagaaaataagctttaataaaaaaacagacaaagaactgatagaagttttgaaatttgaactaacgtacaaaaaaaggaaacaaaatcttccgtaaatgttactttcaatttcatccgacaaaatcccgctatatatttattatactgtatcacctcaacaatgaccgttttgttgtttctttctttttttccgcagtgattcacatttaatgatttctttccaaaactatgtaaccaaatttattgaaaagtctactaaaaaaataattcaaatcccatcgcaatgggcgcgagcgagtccttcacattaaacctgatcataatcatcatcagctaccacagtatcgcacttagaacacacacaatcaaattcaaacaaactttcgcttgacaatttcaatcgaaaccatatcttttcaagtttagctaactatcggaaagaaattacataccgagactaatgattccacagacttgagagagcgcaaagatcgaagaacattcgtcgagagaaagaagaagaaagtgggaggagcgtgtatgtgccagagaagaaggagcagtggatgatttatgcgcttgggctgtcgctttttttcaactttgacgctccacaaagacacaacaacgacatctctctatttcaaaaaagttttatttttttattcattttaaatacattttaaaaaaattaacaaataaatcgccatttgttgttcttttttcaaaaacggaatacgagggtgcagttatcctctacgagcaggtgcatgtaataccatctgatggatttgacttatcgtttatccacaaaagattcaaaatcttcccggtttttaagtttgggcttcataaggcccaattagtggcaaatccatcacagtccactagggtttttgagagactggatataaaatttgattttgttcattgttgtcattcgccgtaatctgaagaagacgaagcaaatcctcccacaaagaatcatcc

SEQ ID NO: 5200 - DNA, 270 bp, Arabidopsis thaliana
tgttgcttccagagaaagctgaaaataataataatcccaatttaaaatcgaaatcgattttctcataccgttggttaatctcgtggagttgggttattacacgtgtcagatgatgtaaccatgatctcagagaaaaagtcacatgccacgtcagttaactttagggcaaaatgggaaaagaatctaaagagcatatgttcgtgcacgttcttgtttagggtaagctcaaagctcaagccgcttctatctctctacatttctctttctgca

SEQ ID NO: 5201 - DNA, 1515 bp, Arabidopsis thaliana
tgaatgattaaagatgaagactttttgttggttcgctttagacaacagtctttagttttgcagataagagaaccgcctcgagccttgttttttaagttagcaactctatggattggtggtatccttagcatctcatgctaacttacgcctaatgataatgacagctagaggcctatttttaatttcttttaggcccagcccaagtcatttatccaaatgctttctctcttaagttacaacaaaaaattgggttagggttaaacctgtggttgcggatgactatcaagtacaattgccgtagaaagcctttttttattatttgctgtagaaagcctttttttttctttctaaagcacacaatttttaattttccaaaattttgatatcattctctgaaaatttaactgcttacagattttggcatttaatattcctagaacaaaatcatgtttttatgaacaacatcataagaccagcaagattagttttgtctattatttcacactcaatagatcaaaaccacaaactccaagaaccaacaaaattgttcatgttttcatacacaaagctactacagtctttggacattatttaaacacacataatttgctgtaccatgcatcagcaactttcgtctctcttggagtttgtaacagcttctgttgagcaccgactgcgtaagggagaagaagtaaacggaacatcagctaagagttttcgccaaagccattcaaagcttacataaggaaattgtattgctgatgggggtgggttccttgagtgccaagagtactttgatatttctcatccgctaagagattgtttggtagctgagagggttttagttagatttatctgtggttgtggatgagtgaaatttactggtttgctttcactggttgtcgtgtgctaatttcgactctaccccttgccaaggcacattcacaaccatgtaactgtagggtaattgagtaactttctttgtcaatccaggaaaaacatcacttgggccgcaccatggcccaaacaaggcacggatctgctttaacctaacacctcgatttaatttaccctatcgatgattaccacaagtgggcctatttgtttatctaccaggcccagcccatcatgataagaaaatgcttgtcactcaagtttttaattaactttccaactccttaccaagaatttgaaactgaaactttttattattgatctatagatctctgatctggaatatatttcggttaaaccaagaattctagctaacgaaaaccaaaacttaaaagttagattaaatatgtacatgtgtaagaaaacgacatcacatctttcctccaactcccaagctttgctttgcgtttaagttagttaagctatgcataatttctcctcaaacagattcaaatatttataacgatccaaatcgaaacaaaaacatatcacacagtttcaaattagagcttcaaatctagttacttgttcttctacagtacatcatcaaaagtcaaaacc

SEQ ID NO: 5202 - DNA, 2000 bp, Arabidopsis thaliana
ccaagttgcatttactttttttcaaatctaggaatgaattagatttttaacctgcaatgggtcagagtcagagatagcatgtgaatgtatattagtcaatgttgaatattaaacacatttttacacatttggtccttttgtgattctagaaactcgatgagatttgtctttccgatatgtttggttaggaaaagactctacttggtgagaaggttttcaaatgaaactaagagaaaacaaaattgaagtttggattggaaaactttcttatagagttatagttttgttttgtaggttagaatttcatgtggaaaccgtgtggcatgtaacctaattttcttagtcattttataataagataatatccgacatgacacgtcacacctcacgcatgcatgcttcatgattgttttcatggaggcaaaaccatcaaacctctttcttcgttatagttattatcaccaatgggaaaactaatgtgttttgattgatccatttttcaggtttcggcttgtaaaaacgtgtacccgagataccaaaagatcttattacaacaagagagactcaaatagagacgtatttccaagagaatcaatacttgtaaatatatacacatacctcaacatgtaaataaaactaatatataaaaacatacggcgtataaatgtaacttctccttctgcctttcggcgttgacccatcaactccttcgcttttaagtttcaggtaaaccaacctaatctcatcctcttccaatgttcttgcttacgtatttgttattcttcttctttttttgaatagaaatgatttctataatattattaattgggaagtgacattatggacgttacaaagttgagaacccttttgctgataatgtttgtttatttgtcttttttttttctttaacagaaggatccaaagcaaaaggaatggagattaattatataacctatgcttttttaaatgagacatttcagatgaactggcagttgttagctttaacattatattagttagggcgatttgtaaataatccagagttcctcaatgagaaaagaagcccaaggctgtctctccgttttgtatatatgtttatgtttgtatttctttgtggttttaatatatgttttgtaattgtaatttgtaagcataagcacatagtatgtgatacgtccgcgtggatttctttatacgtcaccaaaatctctaatagaatcgtaaagcaacctttttacgatcattatctatttatcttaacttacattctagatatttgcattaatcaaagatatctcaatctatttaacaatcttataagagagtctttgtctattgcaaactctaacttcctatcttttcgtgtaaataacttaagactgtgaggatgtctaaacaaaccttaccaagtatagggagaaatagacaccaattcggtttgatttactcaaaccaaacaccaatttgaaagctgagaggcattttagttccagttatatgataaagtactaaacacaaaccaaaaccaaagtattggcctaaaatataccaagccaaagttgtagaccaaactaaatgctggacttactactagacaatatcggaaacacgatttaagaggcattttgtagtcgattaatgggcttctataaatgggctttagggggacagaacttcaactgggaccaaaatattttctcttttgtgaaatcgacaaaagaaatccttaaaaacgaaagaaaacaaaagaaagaaaataccttaaatgcagacacctaccataaggacgaaagagagagtgcaacgtcattagaaagtagccaggccacaaaagaaaaaaggtaaagagagagaccaatcacaggagataacgctaagataaggcttcttacatttaccatcacatataacataacgttactattattctaaaatccaaaaaaactatatgttataacattggaatcatcagtctctaagcagtatcacaccaactcaat

SEQ ID NO: 5203 - DNA, 2000 bp, Arabidopsis thaliana
tgtggatcaagagttcaagaccttttttagaaccaatcatatgaccttgccaattcttactgtatgtccataaagtgggtcttttgatagtgtttgtctctagagtatgcttttgaccatttcaacccgtgggtttgacctattaaggtcttgtcccgttacaactctcgtgtaacaatataattcgaattattcctcttggcgctggtggtttacgtagttggtgatggcatattggcatgttgcagttaatcctcgagtgctaaaaggttagccgtcatggtcaacatgtagaaacgagctctcgagcaactagtcatgtactaaattcgtctatagtgttttcatcgccatcattaacaagtatatgttcgcttgcaaatttcatccgaacattatatctacttgtttacggtttacatctctaaaccgagtctaattaacttaacgcttttttttgttttacaacgagccataattcaaatcatatatatgaaagttagccaactcttctctccatatgattgacacatcatcactttagcatttgacatgtgtctattaaataattaatgtaagctcttcaacttctaatttataggttaatgatatatttattatttaatttacatatttaattgtagtattactaaatttattttaatattacataatttttcaataaaaccattttaatagttttctcatactggaagattttttttggtaatccaaactcaaagtatgagtatataatagtcgtggattacttaatgatttgagtaagttgttatcttaaattgatatttatacaataaatcattaagaaggaaagatacgtaaggagctccatcatcaaattcttaggtttctagaatccaacactaccctttgttaaattggtttaagacaaacgttgtttatgaattatctgtatgatgcattgttgagaatgttattagaaaaaatatttttaatactaaaaataattgtttattgcatggggaaatttgcaaaactaccctttttttactaccttttgcaacaatacccttttgtgttgtccatttttaaaaatatctcttctcttgaacagaatgatcaaattaccttcatctaataggaacatgtaattggaaactgaaatttttacgcaaaaaaaaaatttccgccaaacttttttcccgcaaaaaaacctatagcagatgtgttgttttttgaaaatttttggcgggaatttttttccgaaatttttttggcgagaaatttattttggaataatttaggcgaaaaatattaatatttcattttgttaacctaatacaattttcaaataggggtaaaatggtcattaaaaatttaaagagagtagaaataaaaatgactaaaaaaaaggtagagttgaaaaagggcatcatgaaaagggcattagaaataaattttctattgcatgaataagtaattagataaataaaaattatatttaaattaaacaatacgaaaaaattcgaaaaaaccgcagcgtagcgcggatgatcatctaatggctaataataattacccaaacaaaataatattccttctgtatttttagttagtgtttaagagttttacacacaaattaaagaatcatttagggagcttattggttcttgcattttttctactgatgataaaacaatcaacatattatatttcgtcaacactaattaatttttacatggtctaaaacatcaactaaaaaatacaaggggatatttaatgttcatattccctatattttgttttttaattaaatgtatttgtttttctgaatattttataaatcattctagaaatacaatggattttctttttttgatatatttggggaaaaaaacaaaagagtagaggttttagagaggtttgttggattgttttgctctcaaaatttctttctcttcttcaaatgttcattggaagaccaataccttatcttctactatcttcaccttccttcc

SEQ ID NO: 5204 - DNA, 2000 bp, Arabidopsis thaliana
gttctacacaagtcccatcattttgatgatactaaatcagtagattgctactactattggggctttgtttatgattctttttctataacacacaatatatttcattttaagaaaaaagaatttctagaagaagtttatagctctaaaaatggtccaacaaaaccaccgagaaaccaaaatttaaatcaatgtttaggctcttctacaattgatttcagtaattttctaaagagtaagaacccctttggatacgtttctgtattatttatttttcgtaaggtttggttattttaggatggctctacaaaaaaaatacaataaacatctaaaataacttgtatcaattaaaaataaatatatgcaaatttcatgctgcacagtggacatccagtggaagtattcgagaatgatttaactgtgttgtgttgtttggtcagatcgctgctaattgctattctcaagtctcaaccttcttttactggtacgcactcaaagcccattatcaccgaaaacatttcggtggatattttaataattctctaattgataagcgtgattttatgtcaacttacaaggcttttcaaagcccaaaaagggccacaggcccaagcataaagagaaacattcacaccatatctattttaaagattaataaaaatgaacaaaactgattttaattgtaaaataacaaaaatttgctttcattgagagttgaactcaagacctcccgcttactaaacgggtgctctaaccaactgagctatgaaagcttttgctgttacaattaattaaaatctatataatactttgtaacaaaactttttttaagtgttagttaatttaaaaagcgttaatcaattgaaatgtggacctcttaaaaaaactaacaaatacaaaaatgcaccatttgtccatagagtattggaaactaagtaaaccatcttcatactattggtcacaaccaaatccctttccaatttgtaacggacgactaattttggttttgtggtcaagactcaagataatgctaatttttaaacaaaattacagtgcatgaatctaatctttatttccttcttcttttataacctttttcatacttaccatttgcatgcctctctttaatatttgttttattctatagaaacaaatcacattatattgcattgaatagatttttatttaagtttcatttatttgttttcagacacatatctttagatactaaagatataactaaatatttaaatcttatttctggtcaacccattcagacaaagaatcttaaataaaaaaaactttaaattaatttcttccctaaatatgatatatattttttaattatgttacataaatgtatatatacaatataaatttatagtttttttttggtaagcatataaatttatagtttgaccagtgtcaaggaaacttaataaatcaaacaactttttatactaataaaataaaataactttttgttttaatgatatttaaatatttaattattcaatatatggttattttgataattttattttaaatcatcatcgaatttcttgttgaaatttcaaaattgccgcgtaatcttaacggttttaggtacaatttcattcacaaaaaccactaggactcacttctaaaaatttctcacagccacaactacatctgcatccccttctggttacaaattaattcacctttacattgaaattgacaaaaaaaggtagtgttatctccataaaacaaaattaaaaggaaataaagaataatgaccactccctctctatatatataaacagacgtttatcatatccttaagaatcacccctcttgcgttttagctcccttgcattttcttcatcttgtacgctcctccttggtcttagattttctgagatatttctcttttcactctttcttgttacgattttatctaaaaatttaatgaatcatatttactgaccaaacacattgttgtggttttttcatgcagagaa

SEQ ID NO: 5205 - DNA, 568 bp, Arabidopsis thaliana
gagagtcttttactttggagttcgttaatgtacaagatacaactccggtacttaagttctcttttcgagagactaaacacaaaaatgttaattagaaatagatgacatgtaaaaattaggcctaggcgtataagtttgtagttggcttattgtaagtttgtagtttgtcccttagttccttaatttcttagggtatatattgcttactgagacatccatattgttccattttggtactttgtgcacgccattgtatctggcaaagttgagaatgtcttcagcataccatacccaaatttgtggattttattggcccaaatctagcccatatgttatatatccaggcccaatttatctgtcaagagatggggaatcttttacgatttggtcggaaaatgaaaacggagcaagacagagagataatcggagattccaattttctgtgttaatttcaacaagcatgcatttatttaccaatttgtgctcaaaatagaaaacaaaacaaaatttggtacgtgaaaagaaaattttcaagggattgtttgtttttttctgttcttcttcatca

SEQ ID NO: 5206 - DNA, 2000 bp, Arabidopsis thaliana
aactgtaattaattaggaagaagtgaagttgcacatatcgtggtatccactattactagatatatctttcgaaataaagatatatagcgattaacgcacacaaagtccataacatttgggatttggcaacctcatgtctcaaatatttgtattaaaatattaaggcatttgacagactacactcaatcataataactcaacactaagacaatcataatgactcaacactaagacaatgcttagttccacactgacttacttttaagttttaactacataaagtcttagaagttacaaccaactccacagtagtacactatacctgtgttataattaatgaacttggttagcttgttcgcttaaagagaccaaactataaaatcattttctttgtatctatattttttttttttcataggctctttttatatttcagttacccctaacacatactttcctcgtacccatagctatgaaatgtaccttcctatctttaacgagttacaaaaaaaaaaaaaaaaatcgtttccaaaacatctctccatctccaatttttatgattgaatcttttgtaaatatctaatttatatttaatccgcctatcttacaccatatcatctcttatcccaacatcttatgcactttgatcctctcattttcaactgatttttaaagatatcaatatcatactgcaaaagtcaccccttggtcatatatcgaacgattaattccattccgcttatagacatcgttcttgttccaacaattgttgtactttcagcatgttgaagaagctgtgtaggttttttaataattaaacaagataataattaagatctttttttctaagctggactgacaattttgaggctctttacaattattacaacaattaattctttacatttcagggtatgtatgtatttgtattttataaacttcgaggggtcaaataagaaaatctgaaaattagaggtcttgtataaatgttacagatcttaatgcatcgtgctttggaataacgtccctggacccttgcgacgagacccatgaaacgttggattggatatatagcctaacaaattacaaaatcgatttgattcttaccccaccacaaagtctcatgtatttatgtgtgtacggacactggattcagattttttttgcgtgataaatacatatttattactatacttattctcgcagaagatcaataattattcatatagcaatagaaaaagaaaaaccctataactacatattatatatatatatatatatatatcgttggttttcaaaaaaaaaaaaaaatttgatcaagcaagattcgtaatttcttatgaaggacaataatatcacaagccttttcgagtaaattaacattgtcctcttcaaactttaacaatatctataactatagccaaaaaagattagaaagtgtaatttgaaaatggcttaggcaaaagcataatttaagataaagcaagtcttttcatatagtacatagttttttgtcttctagcatgaatcagactctatcaataattttggcaggtcttagtagaaatagtaccaaaggctaccactcctctatctaacccttttaattattatttatttttcacaaaatttaattcatagttatggcaccccaaaaaaaagtacgaaattattacagttttggaggtttctgaaacctctgcctattgtggaggcttttgattcctttgaagcaatcaatgacctctctgtctctcatttgccagcaaagagagattgtttaatgttgtttatggttcacatttttatacaatatcacattttcactgaatcttcctctgcgtctctcaggtaatttaattctctcttttctctcccatcactctgtctcttctctttattgggttttagataaaatgatggaataataatttcatggattcaggaggaagaagatcattcagttgaagcacacatttaaagggttttgttgagaggca

SEQ ID NO: 5207 - DNA, 819 bp, Arabidopsis thaliana
gtcctcttaaagctcgagctctcatgtttaccctttggacttaccatcgtcacatagatgaatacattatatacgtattaaaatgtgtgtatgtgatgtagtgtcaaatttaatctgtatctctttacacacttctgacatgacattgtgtagatgttttagttgatgatagcacaaaaccataatttaattattgaaggtaacaacataatatgctatctatctcctatgctgatgaagacgacaaatttccaaaaacaattcttgcatgtcttgtgtcagggagtagccaattgtcaaaagactcgaaacaaaatgatacaaatgcaccactcataatttcacgatcaaccatttgtcacaaaacctcaagaaatctaaaattgtgtctaaaacaatgtcacactgtttcctatgttttgtttaccacttggtttcctcctctattccgcttttaccatatgaaaccttgttttgtattgcacaattcaccatgaaagcctaaatttaccatttttggcaagtaaaataatctgtcaacatcagaaggtgccaacttcaatactcaaacatcacatgaaaccaaattttaaggaagaagccaacacaaagacaataaaattaatcaaaaataaacaaaggagagagacagaagaaacagagagagtagttaattccggtggttttctgctcatctacttctatccaccttcgtcccttccgccccaaaattcaattctctcttcctttctctctctttctccttaaaaactctaactttactcatctcatctccaaagtctcaacctttcttctcta

SEQ ID NO: 5208 - DNA, 2000 bp, Arabidopsis thaliana
aaaaatcaacaagcaaaatactgttaaaatattgttttatatataccacgaactatttgtcggcaaatgtatacatatagtatagacatcatacatgggcaaatcgcatatatttgtgtgatgtgataccatagtctcaataatttgaacatttttctcttatttaagcacggaggaaaaattagctatatggcgacttggcgagtggagccaagattaaaaaaaaaaaaagcatgttatttaaaaatatggtagacataacatacaaaaaaatatagtaaaataaacagaactgattgaacaaaagagagtgatcaaagttgaaaaataatttaactataaaaactaaaaagaaaattatcagaggatggagatattaaactaataaaaatgtaattaaataagtaaactataaattaaataagtaaaaaattaaacgtaattagaaggaacaaaaaaaactagaaaagtaaaaacataagagaggaaggagggaagcaaaagtgaaaaccaatgcagtcaacagtcaaaaaccatgatacagtccatgcgtagaacataattaacttaagcaataaatttaataagtaaaaaattaaacgtaattagaaggaacaaaaaaaaagtatataaaaaattagaaggaacaaaaaaaaaaactagaaaataggatcttggacacgatgcttacagattgttttttgtctgggaagtaaatgcccatatctgtttctcgacattttgaagtctctctaacaaaataattagaggaattaagaacttgattgtgtaactttttttttaatcttaaattaagataatactatttcattacaactattattttcttgcacatgttgcaagaacgtgagagtgtacgcagacaaataattaaaacgaaaataaaattataatgattatatacaatctcggctatcaattgattaatagagaaaattgactaaccactctgaattggctcaaaatgtagttattaattcaaaccgagtttcacttcatttatattattttcattttttaactttaaaatatatatatttaataaaccaaatatgatctaaactaaatctaaaaggctccatccaaagtagatttgattttactatatatttaaaacatgtatggtaggaaaatttaaccgaaaccaaattaaacacattttagggtgaagaaaatcacccaaaaaaaaaaggtgacttttttttgtaacaaaacaaaagacctaaagtttagagacaaaataaaatgttagggtgattcaatgcatcacataatacagtattgttaataattaatggctaataataatgtgtgtttggaagtttttactaatctcttctttacaacaacaagtggagtggaagagagagatacacacaaggtttaatgggtcccacattcttttacttctcaaaatttaattactaattttatctaattttggtgctctttttcctcatctacataattgcctttaattatctcacaccatttaactaatcactgattctcttcttccttacgcgtttgtacttaacccccttttatcatcatttcgcaggcttgcgtctgtctctctctctctctccaccattgactctctctctctctctcgctctggaatcatcctttatttctgtgactgtgtgcactttcagagaggagagagaggcccaaaaccaaaagaaaagaaaaggttgtggcttgcagctgaatcaataccatctccatatatacaatacaccttcactattcccccttttgtatttttattatatttttcccatcaaagtctgtttttttagactccggtttgccgctttgtgtgtgtgtgagagagagaaagagagctatctatcctctgatttatggtctctggatctctgacaatcgagttgagttaattacaacacattcctctctttctcaatcgatctgtgaaatccaagattgttagctgtgtctgttttcagacaaat

SEQ ID NO: 5209 - DNA, 624 bp, Arabidopsis thaliana
agcaattatattggtggctctgctcggtcttcatctcaaagtaactttcgtgaaaccagcttcttttttctttctcaaaaggcataaggatatttgtaacattcaaataaggtacacaatgaaaactactactacttacttacttcatcttccagccgtgatgtaataaaatttgcgaggaactttcttgttttaagtcctcgtgttaccattttcatctacgaactttggggattagattccccctcttttgaaccttgttttatgttgtatcacgaaaaaagcttattggcctcatttatcatcatcatccaccgatgatatatcgtttaattatatgttcatcagatattcttgtaaacttaaatgattaaccaaaagcatatgattttaggttttttaaaaccttggtggactagtccacgttcggttgactgatttggatatacatatacatatatatatatatatatgaaaataaccaaattaatattagatgtggttgtgatatacgtacatcattttctttatgaggtggcaatttctcttgttatctgaatgatacaaatttagttaaggacgtagaaaagcaaaaaaacaaaacaaaaaaaagaccaagaagca

SEQ ID NO: 5210 - DNA, 2000 bp, Arabidopsis thaliana
agtttccactggttttctttgttttcgatatcaattttagacactaagagggtgtattcaatctagtattttaagtgatttgtgtaatatttacaaattatatgttattcaaacatgaattttaaaaactctaatggaatacaatgtagttgaactaatgatttaaaaatctacctttaaatccattgttactgaaaacaatttgtagatttgattcttattaattttgaaagatttaagaggatttgaaaagatttctttagttaaaaatacaaaaattcaaatctcatggttttaggtgaaatttgattttttttttataataaatcatatcaacttctctcaaatcattaaaatctaataaaaactaactaaaattcaaatcattcaaaatttaagatccaatatactcccctaattcgtcttacatatcctaccttacactcttgtgtctcatcttctctgccatttgacacagaaaaaaaaagagttaggacggacatatccgaaacaaccaaatagactgtttttaaacagttatatacgaacacgaaggttcagctttgtgatacaccatttatcgtaacaattaaaatatggtaattttaggctaaattatagagtagatcttgtttcaaatattacaatttgcatgcaccaaattgttttacattttcattttccagagaaaaccaaatcattggttagtcacttcggaagtaccaatcccaatattctttacagtaaatacccggaaccgccgagttcgggtgtttcagaaatgaccaatgatgatcaattagtcacttcagagagcttccgggtgaaacgcgcttaaacgatggccttgacaatgacttcctagtactgatgagagagcggtggtgccaaacgctaggaagctgccgaggatgtgacaagattgaaggaaatctgaggttaagacttaaatctttatggaactggattacattttgaggttgatgaattgtattttgattgatattgaaaacatgatgatgtggatatgcaacggccaagtatcgagatttgaattgagatatggatttgatgcacaagtggtcgaagaaagaacgaagtggacaagtacattacctgtaatagtacataacttgtgtggttcactaattcttagagattatgaatcattgtagatgaataggcaagtctatcagacatctctaacttatggcaatcactagtttcttgtacataaagtactatttgcacccaaaaaataaaaatatgtatataaatttactactacttaatgcccattatttttctgttttcaatattgtgatatacattatgcaagtttacacagggatggatccatagcgacattagcattgtagattactaactacgaatattttttgttttttattgttttacaatcaatgtaactaatcaaatattaggaatttacagcaaatgtatcggtaaatatacgggacatagtcagacatatctcaatattttcctttttttaagtctcagtattgttattgtataaattatttataataataaaaaataataataataatagaaaattaagtgggtatctgtaatatttaaaaaatatattgaagaaactttgagatgagtcttttaactattgaagatattcatttaatttttattaatattttttacttttcattattgtagaactcacaaaaaattattgatacgagttatttagtatgtgactcactaaagatcatttatttagtatttatcacatgggggtttattcgttgtatctccatttattacttggaagaccaggagaagagtagaccattagaatattcaaactattcaaagtatttttcacatggttacatttagacgactcaatcatatgcatactcgattccttctataaaaacacacgcagattagtgacccatattttacactcaatctaaagaccatcctctagacagaaaactttttttataaaaaca

SEQ ID NO: 5211 - DNA, 738 bp, Arabidopsis thaliana
ctttgagaatttggagcctaaataccaatgataaacttgaaaaattcagtcaaacataacatctagacgaagatatattcaattcaggaaccagaggttcaagcaggaattaatggcaatgccaccgttcatcatcttaagagaccgaattatagatatagctttcaaaaccaaatctggaatcaacaattagttgctaaactcaaattagcatcaatcaagccctacgaaaatgagactgaatcgagaataacaaaagaatgcttagtcttatatcgtcatcaaatccacaaatttgcatctactcaaaagcgattccagaaaactagaaagctaaacgaagacaagcatacattcatagaatcgtaaaattactaacctgatcggaaaattaacgccggagatgaccgggaaaatatcagtaacccaacgcgaatagttgaaaatgataactcggagagctagctcttctagggtttttggatctcctggagacgaagaatagagaaaaacttaagttatggcggaatttgaaatttcaagcaattaatagggattgcttttgtaattcctaatattaagacataaataggggcattttagtatttgcacacattgctgagtcggtctttaaaaagcccttcactatcacattgacttcagaacaattagggttaatctcttccgttgcttttttttttcaatccgccgccacttttcgtttctcgtagcgttaaa

SEQ ID NO: 5212 - DNA, 2000 bp, Arabidopsis thaliana
aagaaaatgagaaattttcaaatatgttgaatttgagaatggaagaatatgacaaaggtgggtatagtgaataaatggtagggaatatagatatgcccgacccaagaggacagctaaaaagaaagtgacgttcacatgtctgtctttctctattgccccaaccattttccaatgtgtattagtaataacagaaatcatacatttaaaaagaactatatagaaattttattcatatatatatagcagtactagttagtatatctgcatttttttgtttttcaagtcatgttgatgatttattactttaaacagatgccgaagctttctaaagtaattacggtaaatatatgttagtcatttgtaaaaacgaccgatgacagaaagatatgttttatttcttagtatatctaacaatgttataaccgaatgatgacaacctataaaccacaatagagcactaatttaattacatgctctttgttgctggctccgtacaccggccaccacaatcaaaaccttaattgtccactttttagccacttcgaattctcagaaagataaatctaaggaagttctaggtctttcaaaggccacaaatctcgatatgttggtggtttgtgaatatgcaaatctttggtgatacgctaacttcttcaattcataatttcaataaacgaactgagaatttactgatgggtagttgttcaaagctggagtttcttccacctgctgacgtttacttggaatctctcaaggacccaaatctaaggaaatgcttacggttgaaaagtgtccgtccgatttcgaaaaccattccaggtatttttttttaagtcttacaacatattctttccggtgaggaggagaccatgttgtttttcttcccaagaaaatttaacctctattgctatgatcctaagtgtataaaaggcttgcaatcaatggaggttttaattatagtccatgggtgaataatgtcatcaatagtgataactggacaagatttttaaaaaatgccacaaacacaaaagaaaaaaaaaattgaaagtaaatgtcataaaatcataattatgcgtagtgtgcaaggtatactttggtaaaatctgtcacattagacatttacttatttacaattttgcaaattggttatttacttaaataaatgaaacttatacgcaaaataaaataaaatcctgactaagctcatatcttttaatttgttttctaacagaaatatatccctctgttagtacaccacattgacgatgtcattcattattaggaatggaaatttttcattctttcctataaaactagatgttaattaaaaaaaaaaaacaattatacggatttcttaagagatttgaatttctttacgtagattttctgtaagtagtataattcaaaagaagcaagttaaagctaatctccttgacatggattgaatttttttttgaaccaattacccgacaaggatttttttagtggtatttatagattttgccattttttatatctaaaaaatacaatttaacacattacgtttgggtttatttagttccatattttttttagggtatagtgtttgttattaagtatgtattttacaaaaaaaaatctcaagtgtttcattttttaaagttgcagaaaacgcaaaatctaaaatatttgaaggtggcaaatctaaaagatttaagtcacaaaatggcaaaatcaacaataatcctatattattttgggtggtgttgatgagccgttgacgtagaagaatagcatgtggccttatttgctataggatgtggccctaaccctaataggatgagaaatctttgctcaacttggcttagagtggaaccaaccgtgaagcatccgtctcaaaaatgtctactctatgacgtctttttcaccccaccccccccctctccacaaggcccctccatttctgtataaacttcagaatgctttcttgagaatgtttttatcttctttctatagtttcc

SEQ ID NO: 5213 - DNA, 2000 bp, Arabidopsis thaliana
cacatgtgattctaaaaaacttgtgacaagaagtacctaaatatgttgttgattcaagccaaataaagcgtcttttgagctttgtttttcatagatgacaatttgatctaaaatgcttagagagttagagggaaccttttgcctacgtgttttagaacaaagaacataagtgtggagcccttgttcacattttcttagtttaaatattgaagatcttattctgttctcaagctctcatatctgtggtaactttcggcccattgtcgatcgagaaaataaataaaaaaactatacaaaatatggaagaaggaaatgtcagtaacatgttgcaaatgatcatactctttaataactttttcttttgagcaaacactcactctataatatctataagtgtaaatgatgacaaaaaagggtctataaagtataaaaaatttccttcacatgcacatgcccaacttcaagttttgtgtatgatgtttctttaactttttattagtggttatttcccaacttgtgtttgtttggaagcaattatttcaaaattatataaattcttaactgaatgtttgtcgctaatgttataaaaaaggtagtataaaatatgaaattagtctcgtttgcttggttgtaaactacatctatgtttattcatgtgtatattatataatgtacatctagctaacagacaatagtcatgagtctatatgtatataggagagtcgagcctttataatgaaagaaatagatatctacgttcttttacatttgacaagaatcaccagatatacataaatcggaaataaattaattagtgttaaaaggcaactatatagtattaaaatgctcattatttttagtacgtagttggaaaaatgtatgtgttccagtttacttgatttcattttttcatcgttatcgttaggacaaaatcttgtctccaaatcttgttttattttttcccacaaaataccaaaaaatatcgtttagttttaaagttaaatcttgtttaaaccgcgcgatcatgtgtatcgtgacaatatatagttatatactagtatatgttttgtaaggttccaataatttagggtggcaagaattgaattttaataatcctaatggacagccaggtatgttggtcgtcgaatctcgaatcgactgaaccatcatatatagaagatttgataaatataactgagaaaataaatgcaatacaaaaatgaaccaccctaaacgtataatttacaagatagaggtcaatgatatgattagagagcctaattaaataagggacaggtattggaagttgaccaagtaaaaataagtatattaaaagtcaaataaaacatatattccaacatcaacatcagcatccagtgagaaacgttccttctgaaatgtttttatttgcaaaaaagaaagataaattgtcgaaagtgtttagggtttatgtttgggtgtttacagcaaacaacggtcccacgtataaacgtgactggtttgcgcgtttgaactgatgtcatgactgaccacaaatagatattcgccacgtgtattattacagataagtcatgacggccatgttgtgggtccctctgtagctgtttattattcattcaccactttgttgctgtttaatttggcgctgcgccgagccgacaaccaaaagatttttctctttttctgttgtcttaatgatgtcataccaaataatcccagcattgtagatttgtactaatatttttttcttagttcgacccattttattaccctaaaatatagacacaaaattgtgaatgttgttaatatgttcttttgtagtaaagacaatcaagtactctgtttttcttcttttcttttttgacataaggatatacatttttcagctttaaccaattggttggttcagatttctaaatttaagtgaataaatgaccaaaacgcttttaaaaaaataaaaatcaaaacgaatttcatttggttcttttgatattataacc

SEQ ID NO: 5214 - DNA, 2000 bp, Arabidopsis thaliana
ttagctgtttaggtaaagcttagtaagagtggatgcaatcctttcccgttttctctccgcatttcacgccgtcgaagccttattagggtttaatacaaatccataatctctcgtttccttattattaaaacatcccatgtggacaccaggactaaaaatcttgacaatcagctttatttgatgactgaagtatcaaatttaaataaattaactagttaactagttatataatgagacttattttgaccacttaggtccactaatagacaaattaaattatcttatattggttattgtcccatcgtatgaaaatcaaggatggtgttttctaccagggaaatagttacatatatagtacatgatcaaacttgaataaactacacgataatgatcattatttgttgaaatcaaataactttaacaaacaaacaaaaaaactaaaatcaaataagaatattagtagcatagtactttcattataacctttatgaaattttagtaaatagtataagaatttctcaatatgcatcgattttgatttaataatgagtaaatgaaacgaatagaaacaacattttgatttgattaaacaaatagataaaaacaagactcataaattaaaatttggaagtttccgacaattagaaaagctgattgatatcgcatctgattgcaaatctgaccagaactcgaaaatattgaaaacatattttaggaataataaaagagatgatagcttaagtggaagttgaatgtcggaccgtacgtaccgggatagttctaatagacacttctcatttattctttttccttcaattatcccaactgttacacagttatattccataaatacccctagtcaaaatgtgaattcacgagtcaaacccataaatgcagactactgtcggtgtcggtgggtgaaactagcgtaaaatgatttagggtaaaactggaatttcactatatgcaacaaaagagcattcattcacatgtttatgtcttttgtgtgatttatatcttctttcttttgacagttacaaacttacagctaatcctttgattaaggaagcatctcttaattaatctcaagtgggctgataaatttgaactttcatcagatccaagaacccaaaattatatccaaccgatcttcaaagaaacttaccaaataaattgtaaaatagtagtatatgacatatccaccaaatctacaaagttcaaaggctactaaaaccaaattccaccgaagaagaccatataataactataggccaaacaaaactacaaaatcaatttctggaacaatgtgaatttaataagtatggtaaagtctgtacacatatctaaatgacaggtacactgtgattttggaagtggaagacacttgtacaatgtgaatccattttgacgactgtccacaagactcctcactaataaaccaaagtacttcacgtactctatctttttatatcagtttaaatgaccaaatcaaatttcaacatctactaatcactaactcaaacccataacaatattcagccataaacacataatatgttttaagttagtgactagactgacgcactaaatcaatcaaccaaacaaaaaaaagaaaacgaaactgaaataaaatatagcgtgattagctgctttaattcaatcaacgtgccacttttttcaccctaatatcataatcaactcttactttattttatttctttacatcttcccgtttttttatatttccgttatatgatataaaaacaataaataaaaatgcgtaaaaattggtgggaaagcgtcggtagctcacggccacgcagtgatgatgcgagtaagagacacttgtgaagtgcaataaaacccccttcttcttcctctctttctccttcgtcttcttcttcttcttcttccttccttctctctccttattaagaaagaccaacacagacacggaagaagtagcttggttcttctctttgtgaaggtgaatgcgggag

SEQ ID NO: 5215 - DNA, 1202 bp, Arabidopsis thaliana
accaaaaggaaagaagattacaaaagtgtaaatttttacttcttgtggggttgtttctttcttgcaaaacctctgtgatttctctctcaccaattcattcatttatttatttgaccccatttcaaagttttttctccattttagacccaagattattatctggtttttttttttcacggctcaagttctacacgatgaagatcctttgttgttgttgtacagaattaatctacttaatttgttataaacttgccccaactcttttcagtgatttttttttaaaaaatttgggactcaatcaaactccattacacctggtgatattggtttaaaaccaacgtttctgacttcaacagccgagattcaaagacttcaaaaccttccaaaaaaaaacaaattcataactggttcggaaagataaattgacaaacccgagagagatagaggaacacgaacgcttatagtcgatcgcaaataggcctttcacttgaggtgtctgtctcaagttcgaattctaaaagttttatggttttttttgtttaactgtgttttatgttgggccaaattgttttttgcttttaggcattaaatttagtcgggccggccctgcacataaaattaatatgatgaaatgttttgggtttgatactttgattcatagaaaaagtaaattagtctctactgatagtaatttaattaaatactagtatttcattattttgtaagaaattttagaaagggaaaaaaaaaaaaggttacgcgaaggaaaccaaaaaccctttagggacttggatagaaaaaaaaaaaccattttgtgcatcttcttcaagctgcgccgctttctcactcttttttatctctcaaatttgaccttctccgttgttctttcgcatcgctcaggttcgtttcgatctcgaattacatctcctacggattcaatatttgttcaacctaattgttcccatttctatcgcacgaagattagttcggggaatctaatcgtaatcataatgtttttttagattgcgaatcgaaattattgtgatatttaggtaacggagctcaggtatagaatctgtgtgtcgacttgattagggcagatgtagaaaaacctgagaagtagtctttttcagattaactagggttagggttctgatttgatgctcggttttaagcaggagcagaagcttcaatctttgata

SEQ ID NO: 5216 - DNA, 627 bp, Arabidopsis thaliana
tcatcatgtgtataatagcagtttggcaaagtagattgaggaacaaggcatcattggaatgtcattactgtaggaccaaaatagatacaaagatttattgttttcttttgagtttatgtcacaaatatatgtaaacgtatgaaggttttgatccacgtacgattttcttaggtggaaaacaaaactagatttatttttgtttttttcctatgaaagtttaaattggacataaagattataataatcatctcaagagttgcattaatgttctaattgttagattcttgtttgagtttaccatcaagtccatcttaagaagatatatttggcattttcttgagtcaactccaaagtctccactttttgttttctattaaccgagtccagtcaactctgaactttctccgacacttcattgttcttgaaaaagtcttcaaagcaatagttttttttttgtctttttgaagcaattatacaatcaattcctggctattgccgcgttttttcataatctattcctttacttttccctatttcttaacttaaggcaagaacttttctataaaatagatcttgactttcttcttctcctatctaagttcaattcatttgatattccttctaaaa

SEQ ID NO: 5217 - DNA, 1834 bp, Arabidopsis thaliana
ttttctatcctctctagtctcttttgtcttctaagacaataagaacgaaagaagcaaaaaaaaagaaaaaaacgtaacttaacaagaaattttttgaaatgaatggtagcgagtttctatttttttgaattggagaaccttcttcttctggcaattttctagggagagagatagtgaagagaatgggaaaaataattattgagtcgtcagagctctgaagataagaagatacacaaaatttgaaaatttaaatgaaaacaagaaaatactcccaaaagtgtttttagactcaaaataatgttagttttcttcatcattgttaaattcatatgtattggatacatgggttgatggtaatatgaaaggtcttgaatatggacagcacaacgcaaagtacaacaaaccaagtggaataaggtcggaatcaatgtggtttaacgtaaaatggatggaacaaatagtgtgaaatggatataaagaaaatttgaatggtgttcgtatttacttcttatgaatttttctttcatgttgttcgatacgtcaagacaatagttattgtacttaggtaacttagctatctatggtactatttgattcacgaggccacagtagatttggttgtcttcagactaaaaatacaagtatgtacaatctcacatttcccaaatctaatgcttccaatatgttttgcttttgcagtttggattgtatttaaatcttcatatactgtcggacaacgatacctccacaatatgtgtttgtccttcgaacaagcattcgagtcgagaaacaaaaaaaaagattggaagtatgacttgtcaataccaacaagtattttgtattaaaaattctcatttctacagtaacctaaaaagctgtctgttttcataaatttccaattactttttccttttctttctaacacgaataatgatttttttaggtcatgaaacgaataatgactatgttgtgattttcaagcattaaagacatttcaacatcctacacactaaagaacaattcaagtattgtacatccaccgatcttttgttaacatcataaccatcccaccacgttcacgtcactcattttttcaaatgtctctcattgggtttactttctttgttatccatcttcggagaaattagcttgacattaatacttttttgacaaattgtaacgttttctccggagatggataacaacgaaagtaacgttgtctaaattaatattacaacttttgagttcttactaactgagaagatttgtggcttttcagccaccacaatatgtcatacaacttgcaactgttattatccaaatttaaacccacataaagaatacgtctaaaaagcaaacaataatcattacaacacttagtaagttataacttctccctaacttctttgaaattttgataaaaaggaaaatacatatgtacaagaagtgaagaaacaatttatttgggccgaacagtgttaaattttgggccagataacgttaaaataaaaaggagtatttctatttaacaagcccaatatagcccatataacaatccattgaaatcatcggagaaccaaaaaaaggacaaagcaggtgggcgcacgaatctcaaatcacgtcccttaaacttgtaacaatctgacggtgtagattatcgatccatgcagtgtcatatcattggtcagaaatattttctatctcgccactatattaatcatcatggcgggtttcgctgatactcattattgttatttttgacagagagaaatttctcagttacgcttcatcctcctctaagagatcttttttctatcttgggtagtagagagaa

SEQ ID NO: 5218 - DNA, 1205 bp, Arabidopsis thaliana
tcatttcagagaagaatcaaagtcgtttgctatcattaagtcttcttttttgtctgtcttttttttccagtgtgatgtttaaaggtgactcagaggaaaaaaaggagaatagaaagagaaacaaaaaaagaacattttgagctctgttttcttttttttttttctttttttttttgttggcttttgactaaagttgtagttagaatctattttatatcttgaagcttctttaaaaaaaaagttatttgtggaaattcgatttgagattagtgatgttagtataatgaattttatataaaatattgaagccagattggactttagtaaccattgtgaacgtgagaaaatatcagtatctatcgctgaaaattttatatttttctatacatttaaaagataacagaaaagtggattacgttgaaagaccaaagatatgtccaagaagtcatgcgtaacccaatagaaagtcaactaacaatgaggaccacatgtgattggtcttgttaattagcgtacgtaaaacgcgacactatgacaactcgtacgtaatttcgcgaataatatgaatagtaacttcaactggactattttacaagtcaacaaattacttagtggatccaatttaaatgtccaattgttcttatttggctaaaaatgaggcccatatatacataatttttttatatgatttattttttaatgaatttatttaagagtatgtaaacagaaccctcgctctctctcgctaatttggatagatacctccgagcaagggttaagtgtaagcctcgtttgtatttgtaacgtaagttgtcatcatcgtaaagagttaatcaggttaattattttctttagtaaggaatgtgttttacccgattcttctatcattatgttatctttgttgttgaacctctcgattctcgaccttggattttgaaaattggtataattattatttgaccctttttgtttgttatgcttttctttgtgtgtgtgtgtgtgtgtttatttggttattgtaatctttgggaattcttgttttgagtggttttggaagatgtgtcgtgttagatggggatttcgttagggtttctgtgagctaaaaaagggtgtatgtttctttccctaattgattttcgtttgtaaatttattttgcagaatgataactacattttcatggataccaaaaggggttgcaaaggcc

SEQ ID NO: 5219 - DNA, 2000 bp, Arabidopsis thaliana
tttatcatgtattacaagtttggtgtgagtgagagtgttctttatccagaaggcaatgcgtgacccatgcatgatgacacgccgacagatacatttttggttctctgcatcacatatatccacctcacaagtttcatgttttcctttatatacacatcaaaatgtgtcttacgtgcactgttttgaacctggatccaatccatacataacatgatgaataccacgacgacactttagtaatccacacacatgttttataatgcagaaagtaaaattcaaattcgagatatcatgattacatcagcctcccatgagaatttgtagcagatacatccaattgcttaattaatatatgtatacatatttcttgacgcgttatataaaatccgtattattgtctttatttggataacgtgttaccaaaaactcctttaatttatgacttttcaaatatactacatttagattatcaataactataataaaatttagaagaacttacacaaaaaattactacagaaaatatttaaaaataataaatatccccgtttgttcaagatgaaattttgtgattttccagagaattcagtaatctgaattttaggtccatcatcttcagattattctaagtcatttctagtgggacactaattaaaacatcattttagtaaagttttgcactaaaaaacttttccaaagaacactaaaaagtgacatgagtgtgatgcaatatcacaccaaatttggtgtaacactagctgtttccggttaactgtttgcgtcaaataaagagtaaaccgtccggtttgaactttgaagagcgccgcgtgaagaagtcaaatgtcgttgctctttgttttagtcaaatgtagttcgtctcccacatcttactgtcataaatataatattaatctatcactagtatagttgtaccaaaaatgttggctccttgcatttagctttgtttatttgactgtggaaacttgaaatagtcttcttttataatagtcatgcaccgtctcagacctcttattagtcctaaattacctccaccttttcaatatgaataactgttcaaaagctttgagtggtaatacatacatttccgcatttagattcttattcctctctttaatcatggttgatggttgcatacccaaccaaaaaaacaggtaaatatcagacgaatatttttcttttaggctgttttagaatttattttaccatcgagcaaggtcgaaccattaaattgtttctttagacaaagcaagtctaaaactagccaacgttttattttacatatatcacctaatttaagtgatggctcaattttctaatgtaaaagtaagaagaagaaaaacgttttcgaaatgaattgatcttgtagatagatatttccgaagatgctttccaaatcaatattggttagttgttatagactttctttctttttttgtcaactggttagttgttataagttataactatctatctatcttaaagtaaaccgaaacgtgtaccatacgagtaccatccatgacaacgaccagaaaccacagaaactctagaatattttgtaaggcggcatcagtactagtaaactaagtaatgaaggaaaagtcttatagccgacctcttcttcattttaccaacaccacttgcacacacacacacgtgtactaggtcaaaccaaacgtgccctaattattttcctctctttacccccaaaaaaacatctagatactttcatcacaactttggtccgcatattaaaaagagttttagaaaaatatagtaattatctaatcgccaccttcactcttcacactttcctaccacttgtcacgcaacttccttctccacactccacctactactatatatttacacacactttcattacttcttcttcagcaattaaacaatttcttcactgcaattcacaagcaaccttcaaactaaaactcgagagacaagaaatcctcagaatctttaactta

SEQ ID NO: 5220 - DNA, 187 bp, Arabidopsis thaliana
cggtaatttctaaatatagctcaaagaaaaatcgatttcaaattgtgtttcccgttagattctttatcaatcaaaactcagatttcgcacgaatctctcatcaatgtcaaaatcattttcgattcttctttttttttgaacagtttgtgtttaactttttctcagaaattcgaaatcctgatcggag

SEQ ID NO: 5221 - DNA, 1175 bp, Arabidopsis thaliana
gttgtgatgttatttggtgtcaccgtaatttatgattactggggaaatgctaatgcagggtgagacgctagggaagaatacaaaaggtttggttgaaccgatacaagcagtgggcaacactgggaatgtagggctaggatttcctcaaaggagaaggaaataatatgaggtacaagatattcagtttaagggactcttagtgttcatatattacttgagaaattgagttactatataaacttggattggcttataacaagagaggttgcaataggtagctaaatttcatctagacttgtaagagttgagaatcatttacttgctgattttgagaaatagaatgagaaatcgaagtaccaagcaatagacaagttggtttcgatttttattggaccaagcaatagaactgtatcaagaaaacaacatatcggatttatggtccattttctcttggtcgacaattttttgaaatggcgcgacgttgaacaaaaattatacgaacaaagaaagctatttccaggttactgcctttatatttggatgacttgttccaaggggaaactttttttttttttgtctgtcatctgatgatattagaactttcaaaggaaccaagatgattgcaacagctacactgtaatctataaccatcatgccattggacgcatcctagtaaatacataagaaagacactccctttattttggtctccgttcttcagccacaccttataatatcatccacaagataataagtggtgtctagcaaataacaaagcgaagctatatctatatttatttacttattgattgtcgtgaatctatctttaatggtgacatgccatagaattatcactattgtgtggttgtgcttgtaattgtttgtaaaaattttgattttatgaatcaaagattatcaacatctagactttaatagttaaggaaataataatatttaaaaaacgcgtacctaaatctaatgaaaagtcaaaattacggtcaacgccttacgagacgcgtctggttcttgaaagcaagttctgcgttatttcatcatcaatcaaagtcgccattttatttttatttaaagtctcacgtcacggaattatctctctgaattcatcatcttcatcattaccttctttttctcaatctcgattgttttcttccaaattc

SEQ ID NO: 5222 - DNA, 755 bp, Arabidopsis thaliana
taggccactgtgttcctgcagcattagttgtcccatccatgtcctgcatagcagtttactgatgcattcaccatcctattctctacaacggctacacaaactatcaaaggaatcacctttaactttgttggttttcccatttaaaccccctcaaggtgttgggaacagttttgtttacttataaatgcccaagtgaggggttgatcgatcccgggacttgggattcggtgtaccatatataattacccttggaactcttgataattcatctacaactcttgtgtaccatatataaatatccttggaacccttgatactccataagcataatacatttggcttcgaaaggaacatgtgggccaatggttgcaccacctctgttgtcatctcatgaattcaggttcggacctggtctctctctctcccaagtgggaggtatatgaacggcccaattatgacaaaaggaaagaaaattatatttggcttcaatgtccaatatatctaagtttggtggtgacttatgttggttgaagtgtgagagaggtattatagaaaatactctgctcgttctcctccacatatccaagactttggagataatgctggtatccttggctagcatttggtagtgtcgaagcaatcattcctcgggctctcctttctaactgcattcctagaaaatattaccctaaaggcctttgtcttggcatcctcgtcctcttcagcaggaactcatctgtcttggaagaattatt

SEQ ID NO: 5223 - DNA, 1181 bp, Arabidopsis thaliana
gcttcgaacaatcgtgtatacatattaaataaaaataatgagggtttgtaacgcagtcgcattcggtcgttgtattgtgctttttatgtatgtacgtcctgcgatgtgtgttgtttacttacatgagtgtgtaatgagcatctggctctttttatgttctgagatgtttgtgttatgtaatttcacatctatataaatctactttcttctgcttagtttgtgttacacctctcgtccactgtgaactccgttaacgcactacaattagtgtagtagagtgtagacgtacatgttaagatgggattaggcctgttttcgaactcgtattccccattttgctgggtttaaccttgggccgaatcataatttgatgcttgggcctatgaaatggagagattttattagtgatctgtattttctgaacgtaggtaaaagacgtgagaaaatgatcaaaagacattgaaaaagtctcaatacatcgtccggtgatatttctttaaaatgacgacttcttcttctttgccattactgcacgaaaagaaaaggacatagttggtttggttttgtgaaggagagcagttgaagctgtttctcaatgattttgtcattatctagcgtttattatgtctttggcgtactctatcaaccgtatctatttgttaagcacacaatgttaattagtttgcttgcagaataattagcatttttttttgactatttgttcaacggtcaaccaagtaaaaccctatggatgtaattgttttgcgtagcttaatcatcttcaggctgatctctcaatttaataaaacataaatccccatagaaatcttctccgcgttgactattaaaagcaaaattgtgctttaagtgttgctaatgcatggaacaaaaatcccacacaacaactgcgaataatctattgatatgaggtgcataaagtgatcatacatgagaaatatacgaaaagaattctaacaaatcttgtattcataccaattcaaatatcaatgtatccatctaatccaatatatagctaaaattagataccaactccaacgtctttctcaattgtccacaaagtctactctataaatgcaacccttggcatcacacacaatcaccaagtacaagtaaccgagttatatacaacgagtcatcaagagaaagaatccccccaaaaa

SEQ ID NO: 5224 - DNA, 1181 bp, Arabidopsis thaliana
aaggaaatcattcgtgcttttgtgtgaaattgtttgttgcatatgttttacgtggtgacgtccattactttatatgctgtgagatgaaattttttaaataaaattggttatctaaatttagttctacaagtaataagatgaaacagcagaaggccagaagctaatcctgagatcattttattctatgacaagtgtactcagaacaagtctctcgacatggagggagatataggtcctagattcaaactctattacaatatattttcttcgtaaatttagctcatgacagctcaagctaaacctacattaaaataattccacatggaaatatacaaattctacaatcatgattagcacgaaatatgtatgaagaaaagtctgaccaaatagttttatcttttagtatatactactacacgtgaagtttattttttttgtcaaaacataatttaaatactaatgctaacgtcaattcatatttaaatgcttgttggttttggattttttccgctaacctaatttttttgaaataatgacccaaaacaaaaacacagtttttacatatattttgactttttcgaaaaacttcaaatttcgctgatgaaacttaatcacgtattacgggttttactatttaagacactagattaagtgattcctaccaattaggttttctaatgtaaatagataactgatctccaagcaaaccaaataactcattattagttatgattcgtggcattagttgtagtttccaattgatagatgtctttagaacaagtctgaatagtggattcagaagggaaacgagtcgcagaaaatccaaaaaaaaaacaaagtcagtttctggctgtttatttttgattaattgcaaagtccacgaaagaaaatatttgtttcttaattcaaatttatctattgcaactatttctcgtaaattaatttgtgacagcccaagctcgatgaccctaattaatgatagggtaatattacttgctttaaattatcatattccacataaaacatatatcagcttgtatgaagaaaagtctgaccaaatagtgttaaatctatgcaaatgaaattgtgcatttgtatatatatattgacctctacatccaaaacttctaccaaatttcgattcaaaatcttgtagttcaaaagaagattgatcaactata

SEQ ID NO: 5225 - DNA, 2000 bp, Arabidopsis thaliana
catcaaaaaaaaaaaaagatttctattggcttttgtaaaactcccaaatataaagtgttttattctaccaactaaactgcatgtgacgaatcttccagctatatttcttgttgttttctctccttctatcttcttcttacgtatgaagaattaatgatgatgatgattgctcaatttgttcgttagtgaaaatattataagatacgcatacaaattaacctgtttcttctatatatagatgattacaaagcatgtgatgtgggagttggactattggagtagttgattaatcgagctggagagaaacaattacaaagattctttacaatttttaattaagcaaattagtacagacaaaaaaaaaaagtgtagaaggagacaaagagttgcgttgaaggaagaatgattgagaaattgaattatgccgactcacgccccactccttccataaatagtttagttttattttttgcatgttaatgtattaacctagtaaagaaacattgaatttaggataagcagtaaatttcatttggtgacaaataaagaaagaaagattgggttaagtcaaataatggcaactatgaaagttagagatgtgaaaagggttctggtgattccattattgtacctggctgctaacatttttgtttttcttttaaaatcaagaaaaaagttttgattaatcaaaatcgacgccaactaaaaacacgtgtcaaaacgtggttggtgacagtgggatatgagactgtattataaaaagctacatttctcaccaccacccaatctctctctcccttgaagtagactctaagctaaagccaccgtcagattttcagatctcagatctcagctcttcattcgacgccatggccgagaagggcaaaggaaaggttttcttcttctcttctcttcttattcagttaatggtattctcttattattgttttttttttaatttgtgggtcttgaggatatattcaatctttatttattattaacctgaggaggtttttgtatatgtgggtttatgtttgtttgtttttgtgtggattaaaaaaaagagttggctactttgtagaaactatgagaagaaatcagattctctttaaaccccaaaaaaagtaagaaaagaaaagaagagatcagattcttcttctctttttctattttgtgtcagaggtcgaatctgttcttctgctcccttcccttttttgttgtttctttcagtaataagatcttataaacgtcaaatccattagtacatataattttttatcaaaaaagcaaactatggaagaagcagaggatttagtgatgttgatatctgaaaaacaggtaactatgatgaagttgaaggtggatcttgattgtcccaaatgttacaagaaagtgaagaaggttctttgcaagttcccctcgtgagttacttctctctttttcttaacttttttttggtgaatttgattttgattggttttgtttggaaatggactgagtggatttacttgtgtgattgggaacaagagaaataagagaccaattgttcgatgaaaagtccaacattgttatcatcaaggtggtttgctgtagtcctgagaggatcatggacaaactctgttccaaaggcggcggctcgataaagaccattgagatcgtcgagccacccaagcctcctcagccacaaccccaacaaccacctcagaaacctaaagatgctcagcctaaagctccttagaagcctaaggaacctgaaaagccaaaacagcttgaaaagcttaaagagccagagaagcccaaacagccagaaaagcccaaagaacccgaaaagacgaagcaacccgcacccgctccagctcccgcaccagcacccgcagccaaacccgcacccgctcccgctccagctcccgcacctgccccgaagcagccgggaccgccaccgcaagcgatcccgatgatgccgcaagggcagccagcaatgtgttgcgggccctactacg

SEQ ID NO: 5226 - DNA, 735 bp, Arabidopsis thaliana
ctttaatcaagatcacttaaccaattccagtaaaactgcagcaaatacccaaatccatatatcattagaaaaatacaatgtgaatttggttcattcagaattatttcgttaccacaatcaccaaaatctgccaaactaaatcaatcgcatcttcattaaactaagagcaatgaactcaagattctcaaagctattcattaaactaagaagggaaaatgacggagcttacacgaaacagaaacgatccgtaaattccgatgactcagttcctgcgaagctctctcactctctccaccaattaaaaaaagcagatttcttcttcgaattactttctgattcagatgattgcagctttttctatgggtagtgaacaatccaaagacatttcttgatttatagaaagacgaacaacaacgttcagagggaaaagatatttcttctgctctccagatcattctcgcatcactttgaaaaatctggaattttctcttcgtttcttaacctttactaacacgtgatttaagaaactcgcttcgcttatgggccatataaattaggcccatttattttattattgggcttataattaggctgtatattgagcgttagtctccgtctctgatacccaattcgaaaaccacttctcagcctccgccgattcagacctcgcatattcagcttcccagtctttctctctgcgtcgttctagggtttttgttactctttgcttcgaag

SEQ ID NO: 5227 - DNA, 1438 bp, Arabidopsis thaliana
ttcaacagttccactcaaactgtgcgggacaagagggaatctccagtctgtggtcagccggggtatatgagagccatactgagatgtgagtatgaacgatgatatgatcctgtgttcttactatgttctgttggtaagttatctatctatattgctttctagagagaattgcatgtgagagtttcttgtgtggttttgtaataaaacagaaacaaaggttcatttctggttagattgtgatatcctttgaaattgaatgattaatttttaggtgttgtgagcttagcttttttagctacggtaatggtgaagtttgttttgtttttcttcttatttatgaaaataaaatacaattttatgtgaatattttttttattcctcttttctcactctctaaaaatgtcggcgagtctcactaagatgttgaagtaacaaaacatgaaatgagaaatgaaattaatgttcttaccttcatgttaagttgaagtagatcataattatcccatgtgatttggtaccaaagttttttttttcagatctacgtacactcgagtcgacctttgctatgaactcaaatatgatccaataaaattttatattcttctgtgttttttttttttgtattcaaatttggatagaaacaagtatttagtaggtcgtaggtgccataggtggcccttgggaaacatccaatggatacaaacctcatattataaattctctatgccaaaataattaggaccataggttatgttatgtacctcaaccatcctttgattgagacattaaattccttcacgtttgtaaaccacactttcgtatacattttcttccctaacacttcttggcactgtttcttttattaatttgatttttgaaacatatgtcaaaagaaaagaaaagaatcgaaacatttaattaattaatgtttgtaattgcacgttgtacattcattacttttataaagagactgatcaaatgatgattgataatccttttagtgtatattaggcgtgtcaatggtgtatatattatatagtgtctatatgtcataagaaacgtcataaattttatcaaaggaacaacaatttaagtctgattaatctataattctcatccttacattttcattggcatcaaatttaggtaatttttagaatatagcttaataaatgagtaggccaagaggacggctcgcaattagctgtgtggaaagctaaacgatgtctcctaccgtccacgtcagcgtcttaaatcctcaaatcccattggcaacaaaaaaaacattgtgtatataaatacatgcatacttatcactctctactcacttttacaactaactcataagtaaaacacagacagtttttagatggctaagatatattccccttcttttcccggtactctctgtctttgcatttttactctcttgacgcta

SEQ ID NO: 5228 - DNA, 2000 bp, Arabidopsis thaliana
atacttatgcagaagtttactatcatcagtttgttgaggtgattgcattgaataaatttgtttctaaaattaagtctggtcatctcaccattgtaacatagagttttatagtatatgtcaattactttttctaatattcaaattaaaaagaccattaaaatagatggaattataaaatatttttgagcttgtcaataactacaaaattatcatagttataaaaatttaataagttcatcgttgtacgaatgtatagtctaaataaaactgaccagtgaaaagcaaattcagtttaaatgtgacgtacaaggttcgctagtttttacatttatgttgccaattaagatgtagttttacgttacttattttgatttatctaatacaaatgtgtctacaaacggaaaacacgttgatttatactgacatgatacaggtacgcatttttagaacaagagcgaaaaacgaaattaaaaccagtggttgtcgaagaaacaacaaaataatgaaatatttacgtaaaaaaatcgttacattattacttattaggcaccggaatatttcaataacattaaataaggtaggtcataagctaactaaatcatgtctctctacttgctttttctcataaatgcttttgatatccgcctaataaccatatataacctcgacatttatctaactcctcgtctaatttaataccgtaatttgatgttacatcaaaacctcccacgtatattaattacgcccacacaccgctctatatacataacatcaaatcgtcaaagtataaattacaaaatgtattgtttcaccatttatagattacattggaaaaacatcatacggtgaacaatgacgtgtgtgttactggttttgtataaactactagttgcatgattaaagaggtcaacatttggggataaaaaggtaaaattaacagtcggtgtcgtgaccaatttgcgatttgatccagcggcggtgagaagctattatgggcccacgtgggcctacattacccgaatattatccctatcgtctctatctgcagctgttcttgctgattacctttgattattttttttgccttatataataatttatacgaaaaagcatccattatgatctcaatcatttaaagattaatgtaataatattcttataggcttctccacagctcacaatcttatactattgttgttattatttcaattcatcatcattgtggttttttttgttctatttactatgaatatactctatgcttatatagtaacctaatattaaagtcactccaataattaaaagacgtgtaatagagataattattctaattaagtaactcacaggtcacaacacaactcacaagtggtaaagtgggacagttaaacaccgtccaattatccacgttaaaatttcgtattaaataattaggattaaaattggtacagtcaacaattgtttgtgtatatatccgatcaaaaattcgatttaagagcttcattttaatacatggtcagtttctgaaattttagtttgccgattaaaccaatcattaatcagatgttacagtgaaccagacacacatatagtagtttattcattgcttaacgaaataaataaaatatacaatatggtttgttttataggaaatactttaatttttggtaccaaatttttcttataagcaatgagaagattcccaaattaaaagacagaaggaaagcgaaaaaagttccccttttaagtcctactcctctttttgtaatatagaaagaaaaactatatatatacaaaataaagttatacgaagaaaattgtattatatttataagatctagataaaatggtccatcccacccaattaaatacccctaagataaaatcacaatagacaaaaaaaatttaaaaagaaaagaaaaaggaaattcaaccacaaccttcgtcttctcttgaaactctcctcatctctctcaagaaagattcaagttcgagtcttagct

SEQ ID NO: 5229 - DNA, 2000 bp, Arabidopsis thaliana
atatacaatatttataaaattacctacatttttgttattattagttaatttgttattctagatgaaaactcatcctacgcatgggtttttgtttttaaaattgtcggaatatatgattatgatcttttgttgattttgatgttcatttttgtgtgtgtgttaatgtgtaagtaataaagtcatatctattttatagaattataattttttataattaaatttatctataattcgaaatatcaattttactataatataaatatttatagacctattcttcaaatatttcactatcataaatacatacaacaaaattatatgatatattaatatatagttatattacttatgtattttaaaacttgcctaatttaattgtaacaaacaattctttattccatatattctctcgttatctagtacactaaccacaccatgatatgctagtaattcaagtcaacactttaattctcgtcccttgaatatagccatatagagtctcgtattttttgtgtggatatgtctaatgtctcggatgaacattacgtgaaaaatgtatatcagtgttaccaagttatcagaatgcacaaaaagaaacagaaagaaggtcatatgataaatcatattcatataacgtaataataaaaaaatatccaactaaaattactatttaatatgaggttaggtagcaaacatttaaactacaacacaaagtagattttagctattataaattgataactattgataaaaatatttttaaaaataagtagaataaaatgaaagtagtatttgatatattattataattttttatttattgaatgttttaagaaaatttatttaaaagagagattatagagaatttaatgcaacaaaagacttttgatttttcctcaattaattctattaattttttttaattaatatagaatgacacatgttattttcttatgtgatgatgtgtcactcctagggagagagttggccaacttttatatatatgattttcatgattgctattatttattggaatttcagagatttttgtctgctactgaactcagaataataaaggcaaaggagcatgaaaactttaaagagtattatgtgtatatattcgttgatagtagctgctaattaggacaactcgtagatgttgaaaagacactgcaaagatcttgaggacattgctttggcttttttagtcttacatatcaacttgctataacacatccaatgggccttcgagtcttcgacttttgacctatccgtagcttctatttattttattcaactagtactacatataatttttgatcgtttattatgtagtcaacaaatagttttcataaaatgagaaaaaaaagcagaaagatatagttttcattaccataatttatagaattctgtaaccaaaatttctagacttaagtccataacttcctcgaattaggcacaacacaagaacaagttaatttagttctttttctttccatgcttgagtttggtatttttcgactatctttctgtcggatgaactatcgaaaaaccttatttttttaatgttctgttgttaccgaatatataaatcattttgtgataagatttttatataaataatttgggttagtggttggttgattcataattagttaagccgaaaatgaaaatggtaacacacaaaatattgaaagttacaattatacccctggaccgtttcacgcagcaaaatccagcaatcctggctgcttccctgacacaaatacacgaaagtacgaaacggtcgtggatctaaaaagcacaaaacagtacacgtggcatgatctttaccgtccctagataccaccttccaatctgaatatcatctgatcattaagatctcatcaatctgaaaggtcccacaaatctgaacccttcgattttcgattcttcctcgagccttccttccttccttcttcttctccaagaggattttgattgtctcctttactctctcc

SEQ ID NO: 5230 - DNA, 1873 bp, Arabidopsis thaliana
tgacatctgctttgctaaactgagaggtaatggcctattccaagatcataagatatctgttaaaatttaatttggtttagttactggttagctttctatctgaccttctctgttctctagttatcgctttgttttgtcaacttttagtttaagattctttgaattatctatggactttgaatgaaatcccgagtgtgaatctatagacgcatgaatcacactgaaagtgaaatggtcaaagagtacagacataagtacacacacttggtttcatgggccgatatgatttatgatctttgtatgcatgtgggtggtgggatcaaaaatctcatctcccaactaatatccatttcattttgtcaactaaacgtcgtatattatatgatagtttgtggctttgtgcacagttgtcactctatagttgaagacttttttttttcttatctacaagaaataataatcaaaacggttaggtcttttttttataagtagaatctcgaaaattgcaaaaccaagatttgatgtcggcaaacgcatcatgtagactaagtgtgaacttttgattttcttgtgtcaaagaacttttgatattaatcactcgatagctacgtttcatcattattagtttcttctatagaatttttatcactgaatgggatagttcacattatctggtactattatttttactattgcaagtagttcttttctatgcatttctttgaagttgttctctttgtagtttgaggtatcttatatatatatatttctatatgtttgtgtttgccaggaatattcaagggtgttttttcaagattcgaaccaaacgagaaattgggcaagattacttttttgtaagaaccaagtgtttcaatgagtcgatgacatttagagtaagtaaaggttttattctaagatggacagtccattattaatcaactattgaatgatattgccttttaaatgagtcttaggtagcatcgcaataactccatgtttactcaaaactcacaaaccatgaagttaagaatccgccaaatttggaagatgggccaactctaaatttactcaccccaatactccatttattttgggttgcattgatgaaagtaatttgtataattgataggttgtgtatcaaaaaccggatctcattatttgtgatctttgcattagttatttttggagactaataaccatctttctaaactgtgagtaatacaaatataaacaacttcttgttcgctatggaaaataaaacataactctttaggtacgattcacgatgcaaaaacaatagtcatcgtgaataaacatgtccgaaatacatgaattaacaaatgaaacgctcaacaaatgaattgacaaatgaaacgctcaacaaacgaagaatctcacatcccatgatgaaattgggatttacaaataaaaagtagcacaagaagaagggggtagaacagtaattttaaaagaaagacagcgttgattcaccacttgaagtggacttttatagcaaaaagagttgagtaacgtcaaaagagtcaaacccaacttttcaaaggttgtgtaaggctttccatgactccacatcttcttcttttccctttttatccttttctcttctctctcttttattttttcttttgaagtaaattaatttcacgaaacaaatcagagaaccttttatatcttcctttttcgtcgttactatcgtcctttacctttttcatttactgttctctctctctctctatctctatctctatcttctattcatggacatgcaccgaagcgacaaagcttagggcttttctctcatccatggcggatttcttctatcttcattaaatatttccctctttattaaaatctc

SEQ ID NO: 5231 - DNA, 2000 bp, Arabidopsis thaliana
cgacagtctttgaagtaggcctgttggggttactgtgggccgctaccacaccgtcaaccaaaataataagagatagtgccagttggttccacccctccatgctttcctcctcctgcagccagctcaccaaatcagcaattgttggaaccgtgtccccaaacctctcatgaaacagagtattccaaacactctcacactcaggtttcacactgataacatcatcaacgtctttcttcttgggatacttcccacattccagcccagttaagatactaaattctcttaatccaaatctgattggatgaccgccgaatacaatccacatctcattcaccttctttgtcactaactgacggcatattagtccaaggacaagcttagcattgaaagatgccttgtttttgggtattttaaaaagtttcccaaatggagaatcgagaagaaactgcatctctggtttcccctttagtacttttgctatgtcagaaatgtactccggtttagagtacgcgttcatcttcgtctcggaagggtaccggtctagagcaaagagtcttggtggtaactcttcaactgtaagatcttcagtcggagcaacacttggactacctgcaattaaaagtcatatactgttgagcaaacagaagtagtgtacgtacacagacattttccagattataactcaaaatcatatttttggcggaaacagagatttccaattctacttctcaatttttcatcctaaagatatgctaaattccgacaaattctaacactttaatcaaacaagctttacaattctgatacacccaaagacaacaaacggtaaattagagattctaacccagttcctccgttgcctttgtcgcagagcgttttctccgcggggaaactcttaatacacgcttctccttccctggaccatgctgcttcctcgggacttcgtcgttagctttattcccagccatagctaaagatgcgatctcgccggaggttcaaatttcgccggaaaaaacagtaactttctcttggcttcgccgggaaaaacagtaactttctcttggcttcgccgggaaaaacagtaactttctcttggcttcgccgggaaaaacagtaactttcacttcaccggatgtgggagttcagtggcacaattcaactacccaacaattcgaagttatgtcgaattttgaagcaatggatactgaatttcgtttcgctttctgattctctctcaatctctccgttattctctttttcgttttctcggtttcttcgtttcagtttttttgttttttgtctttttcaaaactgaaccgcatcaactaaaccgaaaccaactgctgtagggtttggtttacgccgtcaacttaaccgatacgaactgctgcacggtttggtttatgccattattaagttttcccagggtaatttggtccgaaattgaatgaaaagacaaaacgtgaaaaccagttctcactttgacaaacaatgagagcaaatcttttttcgtctacttttgtaaaaatttctttagaaaatatacttagtaaattattctaatttatttgtgtgaaatttctaatggacaaaagtcacaaaacttagaatatactaaaaactttgttgaaataaagtccaagtcagtaaatagctttgactttcttgaccagctccgagtcatgtccgaataaatgagtgttccaaaaaaaaaaaaaaaaccatggccatgaggaaatttcagaacaggcagacgaaacttcgacgaagctcacttagtgcgagacgacgcgtcaaagcatcgtcttcatcttgacccatataaaggtaaataacaataagttaaaagcacccattaccagtgagaggacttcttgttatatatcatatcttcttcgttctcgatttacgagatccttgattctctctttctctaatcttatctcatctgaagtatagttacgaattcactcgttgttcgagagtagtaagctgaagaa

SEQ ID NO: 5232 - DNA, 1945 bp, Arabidopsis thaliana
accagctaaggttcgagttaaacttgaaatcacagttaatgcctcaaataagcctttaagctataaggtttgaattcttatgtatttaaagtgtacataatccaatttgattggaaattggaatatagatttcatccctgtgattatgtttatatatggaaattgagttttacaagagtgaaactgcttcttcatgtgcctaccaaaaaaaaaaactgcttcttcatgtggcttctaagtgtttaattacgccttcagcaacatgtagagatcttgagaaattgacatgagtctctagagaatgttgaaagctgtggtcgttgaccaagaagattcttactatttgactctatttgataggcctgtaatgagcctaggtcaataaggctgagtttatttgatggcccgtttttctctcttttattgttcttctttttcttgtgaaaataaagaaatctggaagcgttgttgtatcatcatgtatgtgcagagtctagtaaccttgttgttgatgcaaagggataaatgaatgggtcaaggaaaagaacctgttgtctttattgttaatcaagacacttgtagatttgttgtctaacctaatccaacttgactttaagcaaaaacatattccaacttgttcttcaccaaaatgatatgttgaaatatcgtatctactaggacatcaagattttgttgtagtcgttatcaatgtaaccggtaacaaataaaaattaatgagataaattaggcatgatcatatccatagatattgtcaaacaattttctatcttcaagtagtttttggttttgggcgaaaatatgttctctttgacaaattcaacaaagaccattctttttggatgacaaaattgacaacttacccattctttttgggctcatacaatttatcaactaaaccatcagtacaaaaaaagaagcagaaattagaaaaatataagaaaatgactctttctctgtaagaaaaaatccaactacgtttattatatccacaattacgtcctatatacaattaaaaagatctaaattgctctattttcgttagaaagtagttactttttacttttttagaagtttgatctagaaaaaaaaagaattatatatatgaccgttttagatttgaattaaatgattttgttttatttattaattgatccacgttcctttctacaatttgttttttttttaatctccttgataaattttcgtcaacacatacccaaagacctccttgttgtactctcaaattcttgggtcgttctgagtcgtctccgcgttaaatcttttccctttttgatcctttcttcctttcttcttcttcttcgcattgatttggtcctccttcctcttctattctattcattaagaacctaatcttcatcttctccatcttcttcttcacggactccacttcgctcatccaggtaaccacaatctgctctctatcttttgcttcaaaattctcagttcctttcttctcaatttccgtctgctagatcctgggctttcgatttgttccgttcctcttctgcgattgtttcgttccagagagaattatcgaaataattaagcgaattttgtgtgtggttttcatagtcttgggttctttagccgctacatatactcaattatgcccaaaattaggtttaaaattgattaactaaaacttatactttttggtctcgtcttatgttatcgtttaaattgttcttagaagtgaaatcattcgatgctacgtttttgacttgttgctttactttatctatacctttgatttgatcaacttttctcttagcttacaagttagaatcaaagcatcaatcctgattactgttttggtttctgcaggaaggtttattagtagtaaccaatccaagtgttccttttgtttgaagcaacaagctttgtgatattatcctgagagaca

SEQ ID NO: 5233 - DNA, 2000 bp, Arabidopsis thaliana
atggtttaggatatgatcatatatcaaaattaagatccatgtgtcgaatagctcaaatctgaatttgtcaatattaaaggcaactaatctcactgaatcttaaaacatatataaagataatatctacgaaatagatagtctttggtgccaagaacaaggttttttttttgttactgcgaaacacacatggacctattacagaaaaataatggtttgaatatcatgggcaaaggagacagcttatctcttcttctctgttttttttcttctcattatgtccagactgtcccatttcataaattatgcacacaattgtagtagatggcaagcctcaatcacatttgtttcgcattattgtgacttgtgagactaataattaagcttctataatatatatatatatatatatatatatatattcaacaagtactatcacatgtttttttatagattatatattgctgaatatctatctgaatctgacaatgagatttgagaagattgtacaaccactacatgtgtcgcttaaccaaaatataatttggtcaaccaattaagacccgatttatatagtatatgagaattagtataagcgatttatacatcaaaacgtgttttgcacaacttccgctgaagctgtttaattagcatgttcctcatatatagttcaattttccacagctcaaatgccgccagcatataacccttacgtcaaatttcctcatattttattgtgtgtcataagacttgcgtatatccaattatccatacatgacacgatcgatactgaagaatataatttgaatattaatcacgagataactcactcattaaaattttaaaaagtttacaagattacgagatactcacttattggcattaagaaagtgtgaatcattaatcaacttacgtgtagattccagtactttcgcgccagggtcgattcacatttgtttacattagagtgatcagtttttaatctactacacacgaattttccatcgaaggatcaaaaaattctagagtatgattattttaaaaaagaaaagatcacgttttacacgacgagaggactagcaataatttggatcgaggacagctgtgttgagccgtatcatttgcaaatcgcaatctatttatttatttgatttgatttggttatacttagacttcactcataagatcatcccatcatgttcctaatcttaaatggtatttctatttcgcacatgtcacaacttagacagttgactaaatcataactttatatttaggttttaagtattaaaaatatatcaaattatattataagttttgtaatctctttttgttagtttagcctaccaaaaaaaaaagaaatctctttttgttagttcttcttgtcttttcgtaatcaactactatataacctatatatttatttatataaagacattgttaacttcgtcatcaaaaccatttatttatttgtccatttatttgctaccttagtttatttttagtactatatgaaatatcatacattttattttatcttaaattaaatacggtacaagttaaattcctcattaaaaccattgtacgttgtttttagtcctgttgtaatatcatttatttcattgcaagtttgcaaccttacaaaaagtaaaaatatgaaaaggttattttgtgttaattggaaattattacatagtatgtaggatatgaaaataggttaggagaaaagatgctccatagaactcatcaatacacacaactaatatatgaccctaattttaaatgtcctcaaaacgaaaaatctcgacagaaataggctaattgcgtcatattacagtttcgtcttcgggggcatttatgtcaaacaccatccccagctacataattacacctcctaagtaaataactccgccttgaggaaaaaaaactaaaacggctctaaattgaaaacaaaagaagagagagagagagagagacgaagaaacagagagattctctcgaaa

SEQ ID NO: 5234 - DNA, 1597 bp, Arabidopsis thaliana
ctcttcccttgaagtttggtgacatcacattaaaagatgtcactgggatgactccgagttgttgattgagaatgatgattgcttctagttaagggtacacgatttatttcctttgaaagtctggtcttttataattatagtgttgagaatggttttgtttcttagatatggatatacatacaatcaactaaaatatgggaaatagtatctggatcatggatgtcttggttggttgtacacaactgtttcgtctcagaggtatatgctctttcttagatgggcaagttcgttttctgataatatccattgctgctagatgggtaacagtggagagacattggatcgcattgatatagtgtcatcaaaatggacccatcgagctaggacagatattttcattacctgctaatcgacaagcgatctggattctcatggaaccgatgctgttctggacacagggtttgatagaattagatttgctttgatattctccatctctaccatctgttttaacgaaaagcaggcttgtgttggtttgattttctgctagaaatagtctgaagatatgtttttttcttttttgcttcttgtgattgtgttttgatgtctgacatggaatgaggcatcaagggtcttggtgaaacagctattaaacacggaaatattggatttttaaaactggatttgtttctcggacttttgcagatctcgttcaaggtcaagatctcctctaccctctctaagtcatctatctctaatacactttttactccgctatactatcagcacaatattttcggttttcaatccatactatccaaaagacatgatctatgtctagctaattacattctcatcatctggattgaattgtgtgtgttgcaggttcagaaggaagcaagtaagagccctagcaagcagctgagccctatccgtggtaggagcaagagcagaagcaggagtccatctcggtaatgcacactctttttaacttgcttggaacattctcactctttctctgaatctctttccaactgttttacaggtaaagaaacatctcatatcaggtaaaaagctgggtctgttggaagattctcataaagatgatctctcttatgtatgagaagttgaaaaactagttgtgtatttcattcttattagcttgggtttgcacatgggaatgatatatactcagtcatcatcagtttatgagctaagctcagctgatttatatgacttgctaatatagttagtgcttaaaacgaactatcaaaaattactgtcgaataccaaacttaattcaaaagctcacaattcgatattaaaattttgaaaacgttcacaataaatgaacctaaaaagacatgtgcattgaactcattttgatacccggaccctttacattttagttcagtccgtacgatgtcattttcgagagctgttgcgcattacttacttgcctttgtgtgggtgttagtgaatctgtgacccaccttaagaacagttaagactattcccggtttacgcgtaccggacccataacagtataagtgaatttggataagaaaggagccgcctagagagaagaaggcgatcc

SEQ ID NO: 5235 - DNA, 2000 bp, Arabidopsis thaliana
gaatacaacttgaaaagcatttattttgcgtgtattcgatggagaaaagtatttagtagttgtagccttttattgaaataaaaatggttaattgggtgtcgaagaaaaggatatagggagctacgtgtggtggtatctgccatgtagaaaatcgaagcgcatgcacaaagttggactcatgatgagacttcacatgaccaccttcatttattcctcctactcctctctctctctatgtacagtattagtattaaattacgtatataaaaaaaaaaaaaaaatattacgtatatataaaaaaaaaaaaatattacgtatttattttttgtcctagcgtatagacacgtagaccgtagttataagaagttagtcgtttgtccgagcattgattttgtacaactcttacagaacctaaaacagactgtacttaccaatgccaaacttgtctgtcttctctttctatttatttcttgactcaaatttgaatcgaatatattcataatctgaccagaaaaaaccaaaactctaataaacaaaaaagctttgaaactaacaaagcgaagccaaatttcataaaagaaagtttaaacacacaaaaagtcctaatttgaggcattttttgacaggactaataactttatatttcaaaaaaataaagtccctttcacgcttctcacgcgctcggtgagtgacattcccacaccattttcctcatgcatgcaacatttatcatcatcattatcataaacctaatgcatacaaagatgtacgtagatatacacatgatgatatattgtacatgcaacatacatcagcatcagcatatgatgaacatcagaaagaaggaaagagaaagaaacttatgtgatgtccttctcacagagctaaagacaacagcatttttttttccctaagttagcaaaatacccatttcgtcaaatatccgtttcttctgacaacaatttcttcgaataaaacataacaatattaaaaagaaaaggtaaagaaaaaaacaaagattggcctgtcttctctgcctccatattaagttagttattttatatgtatttttatcattactgttgtgggtagagtaaaaaaaacagatgggttttgcagagactgttttgcgtgtgttggcttttctcctttattgtctttccccttttttatcctgcaccttattttaattatttcttagctaattttttattgctacaaatactagaataattttattttatttttgcatcacaagttataaccagaagaaacttatgtagtaattagtacacataaaactcaattgcattttctttttacatttttttttttttttttttggacaaatcattttctttttactaaagtaaatgtttttagtgaacacattgagtacaaatatggacacaaagtataaattattatgagattttgcagtagatattaatttattttagctatgtaaataaaaccgtaaaagtaaaaagcttttatcaaattcaacccacctggcgtttcagttttcattttttttttacctttatgctgtttttatgttcttgcaagtctttctcgcgccacacaaaagaaaagtaatttcttttagagttatgttttattttttttggaccatgtcttaaaaggatctcgagattggcgtctgagataaagacctctactttgcttcctttatcttgctcctcttatctcttcgcttctccttcctctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagct

SEQ ID NO: 5236 - DNA, 1266 bp, Arabidopsis thaliana
tgtgaaaatgtccggagactttttcagagatccgccatggaaggagagaagaaaaagctttgtggagaaactaagatttggcggcagaaaaaaggctatgaagatgactctactacggttggtacttggcctttttaaacaagactcgtctttggcttgccttttaaacttgtcatatttcactacctgccacaaaatttacatttactattagtttatatccaaaatttctagttttcgtaagactatgtcctttttttgtttctaaacatcgaatatgtcaaatttagtattatcttacaatttttttttgttggtcaaaatattatcttacttgtttctcgttttatgaacgtctttgtacatcaaaacagattcaatataccaacaaggattctaacgtacgcaaggaatagttaagtaaatcctctatgtagtaatgggaaattgttaggactttgaagtaagtatcagagactcgtgtataataaggtattcaaagtcaggaagataataaaatatttgtgtaacttggtggccacttagaagaagaaccaagaatatacaagcaaaaaggaaaaaaaactagattccgtaagattttcttttatttcaatcctgattataattaaaagaaggaaactatatccacaaccacaatgttacacatgagctaatgagcaagtcaagcaaacacggtttcttaacgcgtaaccaaacgtgaaatgaactattctttctatttttctcaatattaggatgacatatatactgttatttaacatctatatatctaataacaaactaaatcttcgaatcatacttttctcaacaaaagattgcattgataagttcttaatttaaaatatttatgagtacatccaagacaaagaatagttctctattttcagagaggactgcatgtaatggtagtaatcatgttttctcttaggaaaaaacccgcacaacgtttatgggaaacatgtttgtgtttgaataacctttatggaaaaacaaaaatatttagcaactgattaaaactctttacacggctcatatttaaatattgggcctttagagcccattatggcccataaacacacaacttggaacgcttctagacttttctggatttgcctcatttctagaagctctggagatttcttcttcatcaataaatagaatcagcaaactcaccagctttcatcataaattcgaaattcaattcgtcggaaaattgttcagatttcgaaatcaaccgagaaa

SEQ ID NO: 5237 - DNA, 2000 bp, Arabidopsis thaliana
ctctgctgttactgttttgtattttctagcatttattttacaattttgttcctaaccttctaacatagcaaattagcaatcataaacttttatgcatatatataagtgtaagacagtaaatcttgtatgtggaaagacattttccttcaaaatataagttcataaacgtcaagtcaattatggtcgactctctttagagtacatactacatagattagattcagtcggatttaatgtgtacttaactttttaacttgcaggtcttgcatgacaagagtcgtgtcacaagaccattaaagtcactgaagtttgtgtttatggtgcacattgacatcatgtagatggtattttgatgtaaacgaatgatatatttgtaatattacaacttcaaaggttacatctaaattttgagacttcgatgatttgttttttcttcgaatcactcctgcgactatgcatcagccaaatcccaaatgtgtgtcaacatctcgaaagcacaatcctcattcgttttttactgagtgtgtgtctttcccaagcaatatattcaaaaaaagtagaaagtaaatggcccatgcaggtttcgaacctgcgaccttcgcgttattagcacgacgctctaaccaactgagctaatgggccattttgcaatgacttgttttcttctaataatactattttcaaacttgtgattgcacagttgcacattctcgaggcttggagatgttattagtttaaaaaactctattaaggtgcataagtcaggttcaaatctaagaggtcaacacaatcctctaccattataccaaaaccacctaacactagtttttttcaactaatgcatgtagccctgccaatatataaccttgtttttaaccgtttttaagactgaaaatattcttaaaataataacaagttgacgacaaataaataattcaaattttagcgaagatcgcgttgttactattttaataaatattggactttcatttttttatgtaatcgtataattcaagatgccgccaaagagtggatcttattttccctcctactttttcatctagatttttcgtcataggaagaaagaacagagaaagagaagaacacttagcaaaattatttccaaggaaatgatataattaagctcccgctacacctacacaaagtttacgaggttgagagtatttaataaaatttataaagctcgacttaaataactcaaaaagagttgggaacctatttgcgacctatatatctcactaattactcatgatattattcttaacaatagacagatttagttccaaactaactacggaaacattgaaaaagaagtttagttgatttatctaacatgcatgaaataatatggacaaggatttgtactttgtagttgccatggtcgtgtcaacaacatagttcaaatcctattgagactatgcaaattcatttctggaactacattatatgtattcttttttatccgaaaaaaacactaaatatttcttaggtgaacaaaaaaaagagaagtagatagttccggagcagaacaaaacagttgaacgaattacaaaagaacgagaattctagatttgtttcaagaatcagttttgatgtgcttgcaacttttgcaaacatacaaacaaatatatctgccttaataacaaaagtggaatatgaatcggaaaaaatagtacacttttatggtaatataataatttgggttggtaataatctgcactagaattcaaataaattttcatctagttacctttgggtcataggagaacccaacaaccatctcacaaaattagttgcatctcacttgacctacttctcaagacccttgtaacacaagaaaactaaaaactctacaatgccctcttctcaaaaaattatatatctctgggaagtctcaaccatcttctctaactcctatctcaacacacatattttcccaaaatttggatcaaaaagttttccgatagaagaaattaaat

SEQ ID NO: 5238 - DNA, 266 bp, Arabidopsis thaliana
gggtcatcccctatccgacggttggtatgcaacgttcgggaggctttaaagacttgttatcgatctacaaatcaaattaaatttgggttttactttaacaaaagagatgtctagactctctatgtaataaccaaaactatgtaggcaaaattgcaattgtagaaaatatttttgcaatgctttaaaaccctaaaaacctaaattgaacaacggactctcgttcggccgtttcatcaacaactctctcctgtaaacgaaacaaagaa

SEQ ID NO: 5239 - DNA, 2000 bp, Arabidopsis thaliana
taagaaacgaataaatgccgtggagcataaatattagtaacttggtatattaaataagtgagacttacatttgtttttaaaatttggtcaagggtttacatttctcatttaaagaaatgtcataagataaactaaacaaaaattatagttgttgagattaggtagcttgaatgttaactcaaaagtttcatgctttttcattcgctcaattgcttttgttttgaatggagcaatcagaagaaaataagtttaattgttaaaacaagtcgccaacaatttttgaaccattgaaaacataaaccaatatttgaagcatttaagaaagattttttttttgaatcatggatgttgaaaactttgacttcgatcaaaggacaaaattttcaattttcaatctttatgatatcgtaaatcactttatttttgaaaagtgaatcaaaaaacatttgtcgaactctaatagcttgaactcaaaatttttcagtaatcataaaatctccagattttactgcattttttatttttacattcgaattaccttgtttaaatatgtagattatgtactttcgcttttgttttccttaaccatattgttttccttttaaaacatagatgccaaatattaagtttattttagtatcactttaaaccacatatcttaaacaatttagttacattaaattcaaacaatataatgcaagtaaatgaataaagatggggatataaaaaaaggtaaagaaaaacaaaggtaaagattgctttgactaaatatagccaaataggcaaatataattacagtccttcatcttttctctagctttagaatttgtcttcaaatatgaacataattagtatagtattttgataatcactttatagaaagcttgaattatatgaatcaacatcccacttatcaaaagccacacttttcatttcctttttcactctcactttgacattttaactttcctcataattacaaaaaaatattgtattaaatagtaattactaaaattaagaaaattcttagcatctgaagatttagttgactaatctcagacctaatctgtttcagtaaactctatatatgtaaattaaattatatctctgattataaattaaaaacaaaaaaacaaaaaacgtctctttgtatctcctcaaaagccgaaacaaaacctctctttctcacaagtaagcaacttcaaaatctggttaacccaaattacaaaaaaaacaaaaaaataaaaagtcgctctctttcttcttaaaaatctcaactttgtcgtccaaaactccaaatccagaaacccatacgcaaatatccttctacgtgtttgctcctttcacgtttttctcgaatcttctcgcatttaccaatcaaacagattctaaagttccaaactttttctttctttctcaaaccattctctgtttctcaactcttcactttccagtggtaagatttgaatcatgggtttctcaaattcttaacttttcacaaaagcccaccatggaaatcgaatcaggaagttatcaaaacgccaaggtaagtcatcatcagatttgatcacaaagttcttacctttacgaaaactctcttctctttcctcgtaatcatcgatatctgattttgttgattgcagaaggaatcatggagaacagtattaacattagcgtatcaaagcttaggtgttgtatacggagacttgagtatttcacctctatatgtatacaaaagcacattcgctgaagacattcatcactctgaatccaacgaagagatctttggtgttttgtctttcatcttttggacaatcactcttgtccctcttcttaaatacgttttcatagttcttagagcagatgataatggtgaaggaggcacttttgctctttactcgcttttatgtcgacacgcacgagtcaactcgttaccgagttgtcaattggctgatgagcagcttattgagtataagactgattcaattggttcgtcttcg

SEQ ID NO: 5240 - DNA, 1116 bp, Arabidopsis thaliana
gcagcttcgagggactcttgtgtctactgtgtttctatatgtgtctactttatgtttagttctttagcttttacgattttgtgaggtagtagacttctttttctgtaagagacaaaagacatgatcacataactttatattctggtataaggttcatcaaacccacctggtgatcgattctacatcggttcggtcagaatgtttttggactgccaaatgtggattcgagctctagtttagtttgctccggtttaaacgcaattcatgaataagcaaaggaaatcaatccaaacttacgttgtgaaagaagttgggccgaaaatgtctgaaacccgaataggcttttaacccctaaccccttgaaactatcttgtggcccaattaaaacctaattgtttaactgacacggtgccgtttaacttggcatctttgacgcaagtcgactcattttccgtttgtgttccttgctcatttcttatctctagaaacctgtctgatttgctccgtcgcctaaaaagtctaaaaccctaagtgtctccgcctcgtagctttacccgattcaacgaagagtgaattcgcgtgagctcaagcagtatcgaaatctaccaatcatggcgagtcaaacaccgaatctcgagtgtcggatgtacgaggcgaaatacccagaggtggatatggcggtgatgatccaggtgaagaacattgccgatatgggagcttatgtttctctcctcgagtacaacaacatcgaaggcatgatccttttctccgagctctctcgtcgtcggatccgaagtgttagcagtttgattaaggtcggaagaattgagcctgtcatggttctccgtgttgacaaagagaaaggttacattgatctgagcaaacgtagagtcagcgaggaagatattcagacttgtgaagagaggtataacaagagcaaacttgttcattctatcatgcgccatgttgctgagactctttcaattgatttggaggtaaaatatcgtagttcaaatctgggattatctactggatttggattttgcttgttagagatattatcaaatatcatagcttagtgatgtgatcgttgaatagaaattgatttgagctttc

SEQ ID NO: 5241 - DNA, 1452 bp, Arabidopsis thaliana
atagttatcaaaatggattattttgtcatctgctatatagaagatggtgtcgggtcagacctttatttctgacataccaatcagatcaaccgttttcttagcaaatgtattaacaatcttatgaattagccattttgtgtgtttcaaaactttcaattgccaataaaaatttaactacaatatcaaaatgattcgttgcgttattaaaatgttgttatctcaaaaatctttaatactcttgggtctttttcattttggtcaaaatatttgggtctttgttattcaagtttatgtataatcaaaagccaatcgttaatgttgtatattacactaaagcagctcatttacggtccttttttccatattacccatgtgtcaaaatataatttggtaatcatcgtcagatgtgacaagcagataagttttctagtttgctaatgttaattctgtaatcatcgtcaaataatcagattcaagttcaaccagaaataaagcattaaacaaaaaaatcgatcttttatcatttcatggccaaatcaatgcggctagcaaattcagcttatcaattacaaccaattctataaagaacaaaaaaatcaaaaggtggctcagaagtgcttgaaaggtaatcacgagattaaaaaatctcaatcatgtgataaaaggtcattttttcttcatcatcaccaccatttttgttttcacagaaaaacttcaaatacaaaattgcaaataccgtaaaacaacaaactcaaggttgatcttaaaaggataacaaaaaccagaatctgtaagctttagctagctcgaaaagataattttgacaaacagagatttaaagatttgcagttctcaataacttctcagtgtatcagttgtattatatatatagtgaacccagaaattagggcaaaccctctgttaaaagaccaaaatagccctaacaatgttcaattatttcgaaaatactctcacagtttccttggtgtctccgccattactccaaaacttctgcttcttcgaaatttctaagccttaaagtttgataatttatctcgaaagacatggttttttccgttgcaacaagctctgttacgaacccaaagctccatcatcaccaccatcttagtgacttcaacagaaacagagtatctacatctctcaagataatgaactcgaagaatcacacaaacccaagaaagtaatgttcctctctctttattttctctttgaggaattttaacgaacacgttacgtgcattcttcaacaatgcataacagagtatacatttttacaggtgtgagtgttttgatctctacgatcaattaattccatacaagaaagcttggtcatggcaaaaaagcattctcaatgagaaaaaagctttgattgataaaaaccaagagtgttcagattcattaattatactacaacatccttctgtttacaca

SEQ ID NO: 5242 - DNA, 1313 bp, Arabidopsis thaliana
aaactctcattgtcttgttgggagaaaaatggttgaaatatgaatattgccgacaaaagtcaacgtccatttcactaagcacgtatttgtttctcaccaataaaacataattaatctaacctacgtctttttatttttcatttagttgaaattttaacaatattaataaccatatcaatacaactattgataagttatattagctagaatatttgtaattcatacttgataatcgtactagcatcagcaatatatgtcacatcatgcatctatttataatatccaaattacgtcatatgaccataatcgtatatatcgccataagatagaatgagaaacgggtgcagtctgatcaaccaaactcaaccgaattagacaacccacgagaaaccttatatggtgtggggaattaatccaaaagacaacattgtatatagagagaggaagtgttacacaaaaataaccatttttttttttttttttgaatgtaaaaccaatacaataagtcagtaacgaagatggaaaaaccaaacaataaacacatattttcttgttacacttgagctatgctttttcttcttctgtcgttaattccaacgagatgtgagtggacatccaaggcggacgaggaaacgactatgaagatcagatagtgtgacggtacaattctatttagatcgaaagtagtatattcggtagcatttcggtatgtttttaccgagacttactgagtcatccgataataaaatatataaaaaaacgattataaagataaattgtattaaaaaaaacatgtgtaactaaaattatagatttctttaaagaaaaaaggaaagaagaagaatcctatgagaaaggaaaagatggtttatatcatttctcattgacattagtgaggataaaactttttaaagagattttgaattttctctagaaatttgcgaaaacccttttaaaaaaactagatgctctttttgtagagaaaatatttattttcataatcttgattgaaaaattaaatttttttttcagaaaaatcaaaaactaaaaacatgttagatattagtaccattcaaggtctaaattatatttggtattaaatccaaatgaaattatgtttgaccaaaaaaagagatctcgtacacgccggcccatgggcctttacaacagattgaaccaaaatggaaacatagaccaatcaggataaggtatatttctctctatatttgcacaattcaacaacaacacgatttctcacacatttcaagttttcattatcatccagaaatcttcttcttcctccgatcaccacc

SEQ ID NO: 5243 - DNA, 2000 bp, Arabidopsis thaliana
ctgaaccactcttattcgattagaaaatttcatgctattaggatgccacaaagcattttgaaagcaaatatttgccaaatataactatatttttcaaataagctagatttctagtctttgaacaaaggatgcacaaaacgacatttgttgtgaaatagagggagtaataatttttttttttagctcctttagattcaatgaatcatatggttcgtagagaaattaaagttgaggttttgaagtgaaaatgataaaactttaaatagttaggtgatataaacaaaaaaactaaagcatggttcaactatagtttgatttttcaacctcaaagcttagacagtggtaggagaaaagtgtatcatttcacgaactctcacaaatatatctcctaaccgaatatttaaactgatttcagaattacatacatataaagtaaaagtagcaaatagataaaagagttttaaatagagatattcttttccgtacaacatgattccaaccttaaaataattatgtattctagaatctactagccacataatggacattcatataaaaataagattattaatattaataatttttatattttttttgctgcaacttttttggagggtggataaagtccattcaagtacaaatggtacccgtccattaaagcaaatttgttcattaaaaatcttttggattgggttacgtaaaatgcgactatattgccctagttcttttcatatttggttaagatttaaaactgtaaatctccattcatctttgtttgattttttcaactgttttaaatcatcctataatatataaagttatgaaaaactcaatctttttctccctatattgtgattcaaaattaaaaaaacggacatatattacccaattaatggaaatgatgtgtgttcaatgtcccacatcgactaaaatattcagataatgatttagaataatattatatatatgattaaaataaattcaaattcgaatgtataggaaagcttaccttaacaagcatccaaatttaaaattttgtatatgatttaattcagtctttagttttattgtttagttttaccgagaatattaaaattttctaatatcaataaaaggttttataacattataaacatttgaacaaataaaaataaaataaataacatgggacaaattgtattgtggtatacagttatatggtgagatgaatttttgaatcaacattaataaaatttagaatatcatcaatctgccgctttattatttttaatactaccaatattagaaatatctaaacaacctaattaagataagattgtatataccaaaaatttctctgtgatatacagttacttaataacaatcgtatattataaaatataaatttcttagaaaattttacaatttgcaaacttatgtatataataaatagtcatcaatttttaaactactatttttagaaaacaaatcatgagatgtgttatattacagaacaaagttatatgatggacgggtttgaatcaatatttataaattttttgaaatcattaatatgttgtttcaatacgggttaaattctcagtttattaacaattgttatgtggacttgtgatatatttttacttaataacgattataaactaaaatagaaatattttataactaaatataatttataaaattttatatatacaaattttaaaatataaattgtcttgcagtttacagctaattaaaatttagttgtgatattatatccaattatccatataactacacttttttctccacaattagggcgtgacaaatggcaacacttcaatcaaggaacagaacacaatgtgaaaccagactgttctcatttattttccagcaagtcaaaaagtcaaactcaaaaagtcctctctcggtcaactttcttcttggtccccatcttcacaaatcacaactctttttatttccaaagaccaaaaacctgagaacacaccggcgacctgaaa

SEQ ID NO: 5244 - DNA, 2000 bp, Arabidopsis thaliana
tatgtgaaaaacaacgttccaattttatctaggaactcgcacaccatatttgattagaatttctcaaaacattatttttatttttacttaaatcaatttctcaaaaactttatatatgccaaatgaatagagcataaagttttatttttattggttttagtgttatggatagagcatattttatacattatttttgagtgaaagtaaatctagaacccaaaatcctaaatggtcgaatggtcggctgatcatcggagagtcacttttcaataagcgaactagcaacttgtcgacttggtaaattgacctaatttttcttttaaaacaacttggttttctaacctaaatatttttccattcataacattaaaattttagaaagaaggccaaatttaaatagactaaaattgtctagtggccaacccctcagcaccatctcgtatactttagaaaataagaaaattgagataaggaatcttcttccgaagtcacgaagacaataagtgaaagcagacaagaactgtccccctgatttcttttgcaccaaattattatggatttgtataagggaacctcacttaaggccagttaagcacaaaagaaggtttttatgcactatcctttttgaactaataatgttagctttttaaaacaacaacttgaaaacttttttaattcttgaaaatacattgcgaaaagcagaatgatttttaaagcggggaatcttttttttctttttaattgtgggaaagattaagataattcatgaaccatgtgatggccatgttttattacaactgcatgggctcggggctttcttttttctttatttgttaagggtccaatttcgagagtagtgtaaatccatgtttatgtcctcgatcagtgacaataaaatgtgtgtagtttcacagacatataaatagtcagagaattcattgtttctgttttgttttgtagtatatattgtatggaaaaagggtgaattgtgtagtctagtctcattaatatagtaagtatagactgtatagttgtttttaattcattgttgttgtttctaagaaagtagaaacatattattgcattaatcaataacaataattatatcaacaaaacaaaaatagtcaattgtatcattgtatgatacatatatgtatatagagtattacgaatatggaatttcttgtaaagccagatgaaagaacatccatgaagaattctcttccatatgtttacaaacaaacctttaaatgccatcacatcatctctttgacccaataaatatgaccttaaagatcttcggttaggaaaaaaaaatatcagttcgagttggagatcttgatcagctgaatcctgatgtgggacaagacaagtaaaggagaagctgcacaattaattccataaatttggagcataagtgggccgtcattgggtaagatctgggcccataatctctgaaaattgtctaaagtatttaactaggatctcaaatgatttgatgattctcaatcattttataatgttgtttatattttggtgttaatgttttcctttacaaatgaaatgaaatgttaaaacaatgagaaaacatgattgggatttattcataaaatgtttcagattctgcaaacgacgattcaatgcctaatttcatattacaataaagttggagaatgaatgaatgaatatacagtaagaacgaactaagaagaccgcagtctttcatcggcccctactaattttattattggttttttaataattgttattgttagtgtttcgtacttttgacctgtcttgtaattaaaatatatttatttattccccaaacaaactacccaaataatttatttatataaaaaaaggtaagaacacaggtcagcgagttggactcatcaagcttagggagagaagaatcgtagaagaaaactcgaagacgaagcaattggtaaagactatcagcagaagaagcttgcggattggggttttcattttctgta

SEQ ID NO: 5245 - DNA, 2000 bp, Arabidopsis thaliana
agagtaattgaatttagggttcttgagagtcaaagttaacaaccctttttgtttgttgggagatcaccctatttataccgtcgggtcctcgtcaaaagtaattcaggtttgaattcataccaaaaaaagaaaatttaggtttgaatgttttttttcatcaaacattgtaaaattatgaaaaaagtatcagattaaaaaacaattggaaataagaaaactctttacttcttgttagtcaagtactgtgaagattagtggatacagattatttgctaaaaacaaagataaatagacaataattgctccacaaaacaaaatctaattgagtaattggtcttcttcttctcattcaagtcgtgcttagctttgaagactctttgatcatctttacaccacaaaatatcggaatcggtacatgtcttggcgaaggagcagcacacattgtgacggaaccatcaaaaaattctacttcttcactcggtgtttgaatcggtttctcatgaaccgtatccggtttagattgagattttccggttttagacggtttaaaataagctttttgtgggtaagaaggtcgtttcttcaagccggagcgaggaaccactttttgacgtacatgtaaaaaggagttacgacaaaagtaatggtaaccaaatccttgttttgtaagaaacggaacggcaaaaaagtcttggacgaagtaacggtgtactaacattatcgacaacttcaaagagagatttgtgttcttcgatgggttcttgttcgtctattgctttcttaggaacgagagcttaatcaattgatagtaagaaataatgagagggttaaaggttatttatagtcattgagttctttactaattggaatccaaatcaaaaaaaaaaaaaaaagaaggaattttactccattacaaattaggaaacatgtttatgtaagtttgtgttgtttctttttttctatgacttaccgatatctgcgttattgttatttccttaatctatatttattaattttcaaaatattatcgcttaacaaaaaatattaaaagattctcgtcttcttctcatttcaagtcttcgttagctacttagcttcgtagactctttaatctattttttaaaaaaacaaacaatgtcgagagaaatatgaaatatgtataatgtattccttgtttgttaaaaaaaacacacactctttaatcatctatctgacgcaaaaattagaaatatgtattctttattaatttcaaaaaaaaattaacatgttattcttgttaaaaaaaaaattaaaaaggagatatgtgttgcttccggaccttccgccatgcaatatcactattttaacatatatatactgtcgcaacaaataaaagctcataaaccataattaattaaatctatttgttggttgaccaaacaaaatattagttgtaaaaaagtaaatatttccaattaaactgatattatttgcttttcacctattctcatcagatattgtcgcttgtattttttaaaattaaaccaaaaacaaaccgaattgttttcgctatacatagtcactcatcgaagttcaaacaaaggccaaaccaaaaggcaaaaccatcggattataaatttatttattgatatactaattttctaaatttgtttatcaaattatttttctcacttttttgtagttcttttatttgtgaaaatttattttattttataatatttaaataaaatataatacatatacattaaactaggttagctgaaatctccatgtgtcatggttgtttctagttagaacttagaagtgaccaatcttacttgtggttgtggaacaagtaactctaaataagttgcaacaacaaaacttcttcaaacctacttctcatcaaacctcaaaaccctaactcctctataaatacacacaaactccttcataatctctccatcatcactcacaatcaaacctctttccagtgacaactcaaacccctaatccccaaa

SEQ ID NO: 5246 - DNA, 809 bp, Arabidopsis thaliana
aaagagaagtgtgttgtgtctcttagctgctagcttagtttggtagttttgaggaaaatacacagaagaagacagagcattgagtagactgagagacagagagagagagacgacagacagacagagagaatctctttatctattcattaggtttttatatgtgcactcttcagaacaataatggctgcctccttttcttttttttggttgatgttacctttttttgtttgaattcagttctcctttaatatagtttttgaggcatttcttgggacgagttctaacactaaaaatatattaattctgaagcatataccaagataatatactagttgactcttaattggttccactatttgaaaagaaaacaaaaggctaatttggttgttgaggaaagtatgagagaaaggaaactcaagcagatcgtcgaggagatcaaacgttacttttactgtccaagcgtttatcaacatttacaattttattgacttgttcaacatgcttgttccttttttggtcctaatactttcagttttttcactaaacaatctaatggaagaacgagaaacagttaaactaaaccaattggttaaagatattgaaaccgaccttgaactgatttaactcagaaatgtcggtttcgttgtttgtctgaattttgtgaacctcgagaaaacaataaaataatattaaaaaaaagacagagaaagagtctctgtttctatcttcttctttttttttcccggtaacagggagctcgcacgggcggctacgaaatcgctgtattttcaaatcgtctctcagtttcc

SEQ ID NO: 5247 - DNA, 1205 bp, Arabidopsis thaliana
tatatgaacgagcaggtttttcctcatcatgtctgaaaataaaataaaaacaaaaaaaatagccagacatcatttgattctccacaaataaggaacatagtaagtttctctgaaattttaggctgtaaactatacattatattcagttcagtaagaaaataagtttcggtgatacaaacattgtagttgtaaagaagagaatcagttttgttaatctgtgacgtatacttcagggttctacaaccaccaaatccttttagatcgattgcccctttatcaagtattcttcacttatagcatcgttttagggaagacgaataattaaaacggggagattaatcagaactattgaaaagactaatcagaacttaagaaagccaaacaattataggcacgaataaagtatatataagctaagctaagctaacacaaacaattacgccaagccctaatttaagcccccaaaaaaaacataattcttgaaatgaaaacaagtgttaaatatcgtttcgtgcattttagttaacatgaatcagccttttctaaaagcctaggggccttattggttaaaattccacacaaagcaaatttaaaaagaaaaccttcagtatagccgtatactacatgtttgattagtagtttagtagaacaaaatgtatttacttggaatgaagtgtaacaaccgttttattattttttctttttttggtaagttgactgacgtaaaagaaattgtattctcttacagataattagtgtctggcttcagactcttcatcaggacccataaacaaagaaaaaacagaaagaaaaggagaagaataaatttcggttatgcctcattcggttatcttcttttacgccttcctaacttccttacaattaagcttgagtactcttcttacattttacaaaaccctttagtttaaatggttgattagtaggccaaaatccattactgaacgtgtaacaaacgctgtgaaagtcacagacttactcgtcaagaagaagttatggctcttttcgttctctctttcattgtgccttcatcgaaagcttgagttacgttcttccacagtgcaacaagaccgtttactttgactttgaattttggtccgtcactcttcacaaaaccatgcatcctctgtttcaggctaatctattggattcccagcgactaaaacttaaatcgaggaaaaaccatt

SEQ ID NO: 5248 - DNA, 994 bp, Arabidopsis thaliana
ttctatatttttataatatactaagtaatattttttcctatgtaaaaacgtaaaaaaaaaaaatattttttcaataataagaaatagtatttaaatgttcatttagattaaatagattcaatatagtttgttaaaaatgatttatcaattaaaaaaacaggttatattggattagactagtttcgtaatggctaaaaaaaagaataaaacatacgtacgagaacaagacgaagaaatagaaggcatccactacacaattgtacatgtcgacaacaaagtcaacgacataccgtttgagacaccgtggctttcgcttttctctcaaaaaaaaaaaatcaatcatgtttttttggtttttatgtttcgacagtatttggtaggttgttttaatattattaaaaacatacttattatttgtgtgaatatgtttaaaagcaaacttggttgtttggaattgtaatatcaaatgtcaagatccatcaactttcataaaaattcgttaatttgtacgtgaacaattaataaatctctcataccacacatattattgctctagtcaatttgtttcctttgttttcagtcattttcaggaatcaaatattagcaatgctttaactctactccactgcaaccaaattggttgtttagagttatcaaatgacaaaactcgttaaaaactcgttaatatctattaaccaataaatctctagtgaacttttttcctttgttttgttctgtcattttcaggaatctaaattattaagtcttcaactctactccaccacaaccaaaattaaacgagtcttgtctacatgacctaatttgcttaacaaccttatcatctcactaacaactccatctcccaaaatttaaactcctttaactatgcctataaaaccttgatccattcttcatcacataagcaacccaacaaattcattctaaatacatttcttttcactcaagaaattaaaatttcgaaaagtttgttaaa

SEQ ID NO: 5249 - DNA, 1430 bp, Arabidopsis thaliana
acatggttcatatttattcatttcaaaagtaagttgttttgtgatttggctagctactcaagtatactctgcctctgactttgtgcaggccagaagatgacactgatgtgttgtgttggaagaagactcccctaggcaaggtaaacatctcgactatgcctaagaattcggtttcagatctctgtctgtacctttttggtgtttctaatttgtgatgatgatacatgtcttatagggtcagagcgagacacagaacagcaagagctcacggcttatcggccgagtccttccctgcagcactgcagctaattaagggagctcgatgagggtaatacccattttgtggaagtggaaccaataggttttagcaaacccattgtttaggacaatgtgacacaaaaatgtatagttgcaaaatgtgtttcaagaccatattttagattagcatatactaatcactcctttaacagacctgaattttactgtctttggacccttttattgactgagctcattatgttttcacaaattatctcattcattaaaacgaatcagaataaagtgaatacattagtcttcaacttttttgttacaaaaagtggataatgtttaattttttcaataaactgatttgaaattagaaacataatttggataaggttttagtaatttgggataagatattgacagagagatatttataaattatctggtttcactattttggtaggaaaactccaaaattaaatccataaccctaatcgatatctctcttggacaggccagcacatgtaacgagcaatcgtgaccgttgagacagtaacacgtggcaacagtccttatgatgagacctttgatgagaatcagcagcctccatttctgtaagctttttgttcctcccaaaattcccaaatccatcttcttctccaaacaatcttctctcaaacattactactattttccaggatagcttacgcagcttcagactcgggttcttcttttcgatctagcctccgtcctctttcttcttaccacggatctcgcctgctctttttccgtacgacggtctgctttgtggatagtttggctgacgacgaggcgatttgaacattaacagttactggtacttggagtttcaaacatttctccgatgttttggttttggcatttagtcacgggaatgattaattgattgattgctgtagaaatatgtgaagaatgacacgtagaagaatttgatgaaaccttgggatgcataggcttctgtattatggattggtgattttagatctccatttatgtcgtttcacatcagtgtcttgtggttttagctatatgctgttttggttttaggttgatatttattgtatggtatgtgtttgttaaaggaatgatttgatgatgtttcactgttagggtaattgccaagg

SEQ ID NO: 5250 - DNA, 1921 bp, Arabidopsis thaliana
ctccgatgcaaaacgttaatcaaaccccaacttcttactaactcttttgaagtgagtgtgtgtgtgtgtgtgtgtttgcaacctcaagaggtgcttatttatggtgaaagtaaagaaaacatagccgttaggtcaagctttttgggctgtgcatcgattacctaaagaaatgcgaattaagtagaagcgttttggttttgctcctgtcttcttttgaacacgtctcgacatgcagtggacttaacggctatctacctttaatttttcactttctttctcacaaacaaacatttctcactcagatcttgtaattatttagccatcaaatataaaattgtaatcctttagtatttattattatttaaaacttacgttacatattgttttattttatatttcaatttacaaatcgataaatatcccagtgatacaataataaaattttagtgggcctttcaaatggattgggtatgttgtaagaaaggctttgcagtttcttctcctctacctttaaagcccaactattagtagaagactgaatcctttttgattgtcttgtagtttacacaatgtacacaatctttctcctaattttatactctttctcctctacttttaaaacatcaactactgtagttggacaatattagaaattgtttactttctataatgaggatttagtgggggtgaaggatctaattaaatatttgatgatcgttcctaaactgtgagatcgaaatatacaaatttctacttatgttttagtccaaaaaaaaacgtaatagattggtacaaatcctttttgaggaaaaaagaagttttaaggcgtaaagaaaagacctgagaatatgaaacctcaactaactaatttatcaattgaaccttccttcgtttataacagaaaaagctaataaataaaaataaaaataaaaatcagagagaccaaaaagaagtttcgacttgttcaacaattgagttattgaagaatacgtttgattgagaagcttcaacgaccgcaattgcccaaattcatcaattggagttttttataaaacaaattgcatcttaaggttgttattgttgttgttgtttatctgtctgtaatcatctttctatctgctgtctgatacatctacgaatcttatgctgtcttttgggttttcttacacaaccaaaaccaaagcctagttttgttttgacttcatttgaagcaaacctctttctttcttcagttatgtgggtttttgagctagactcgaatcagttctgatccagtcggattttgtattgagtcataaagaagggatttttgggggttgtgagtgatatgaagaagcgggaacatttgggattagggttcttcgagtggcagattatcttatggttatcgatttggttggcgatttcgcaacaagcgctgggattgagacctattagggagaaacctcgatcatggagtgacgaggtatgtgtgtgtgtttttactttattgatgattgttcgaaagtttcttcatttcgatgtttcccagaaacatatttttatgttttgttcgtaattttgatgtgcctttccaactaagaattcgagcagtttgctgtcaaatgttttttttattgacttgtttctgctcatgatttgctgaacgagaactggtcataattgatgattttttttctaagtctgagattttctgagtttcgaagaaaatggaccatattgaatgaaaatcccggagtagagcagctctgatctaagttttatcttttgatttgattgagcaaagctgaaaatgtatataaactatttacattagctcgattgagctcatcggtatctaagctttgttctgccggcgaatactttgagatgaataagaatgaatctgtcgttagtagtgtggtgtgatgagactacaata

SEQ ID NO: 5251 - DNA, 1891 bp, Arabidopsis thaliana
ggaatgagcgtgtggagacagactttgtgtatctattttgaaggaaaagaatcagaacatggttgatgtgttttagggttgcttgtgtataagagaacatgtgagtgtgtatttgtatgtgtgtgtgatttacgagtgtatattccaattcattacaacttatttgaatcctgatacaattgcgagatatccaaactcttcattactattaatttctgatacttttgcagatgttgtagttgatagacaggcaaaacagaaggaagaagtatacagttgatggtaaaatctagttttaacaagtgaaagagagctgctaacctgagagatgactatatttctgcagcaatgcccctttttattacacactactgtgatcttcaagaacaaaaagataatagaatcagttatgctagaattcatatcagtagctaatgacacaatgcatctctataatttcattatttgattatatctataaactgagatgatggaaacatggtgcaaaatcctaataatttgagattagatttcttctcaagacttgaaacacaaaagaagaagaagaagagcatttgatccacaagagtgattgagccgagccaaattattctccctgctgagatcggcagcgagaccactcttctagactctagacatgggatgcagagaaaccaactttttttatttaaacggctgcgttttaagtcatgttctcaaatgataccagttttttttttttttttttttttgctaagcacaagtttgatttgttgtttggcactttacgataacatcattttactcctatactttctcacggtaagtgattaagataaaaacatgcacatttttcgaattataagctaaatttaaagggatctattttctatctctcaataatttttaaattttactcattttctatttctcttataaattaattacttggtaatttagttttgtaatcgatactcaaaaatcgatatccaacaaaggacaatctctttgcggtcaatagtcttctcaaattacttcatacaattatcatactgtttggtaaaatttgtgaatctgcctcataaaatgtacgtggaaagtggaacaacagttaatgcttattttgaccacaagattgagaaaattttgaaaagagtatattgaccagttgctgacgttgcatgtcattctttaatgttgttgttgactgcaacaaaaaataaaatacaacatacaaagtaaaaaaataaaaataaattaattgatctttgtttctctattccccagagagctagcttttcagatctaaaatcagaatctgacggctgatatccctcgtgaaaaacaccccaaccgtccagatgcaactgcttgctgggccaatgatccattctctttcccgaaatggattaatcaatttaagccttatcacatgctggcccattttctaactcctcttttcttttttaacttacttttctttcttttaatattttagttgcagattcattttcgaaatcaacgaaatttatgtttttttaattttctgggtatcttaatcgcgagattttttattttaatatcacgctcgaatatacaattcggaatgtgcagatgttttttttgaaggcaatttagaaaaatagacaaaaatcgaacaaacatatatagaaatagagatctaaataaaaacatttattttatttcctcttggaaacaaggaaaaaatgaattggggtgggtgacgtggcagtcatacccttgccacacccttcctatacgcatataaacagcagctgcgaggagagagagatttcagagtattttctagggtttcgttttttttaaagatttagagaaaaaagtgagttattaagagattccaatcaaa

SEQ ID NO: 5252 - DNA, 1842 bp, Arabidopsis thaliana
acccaatcacattcaagctggaagattgcaattctcaaattgatgaatcatcactttcttctcttctgacttgtctctttttttcccttatactgtagaatgtgactactttctgttgactacatgttattgaaagaatttttgagtctttttctaatatccactctttactattgtcttgataccaaatacaagcaccgttaaactatttaacgttgaattggtgaaactatttccctcggccaaattgttcggtgaacgaaagatctgatctgtgaagagtttagttgaatagattcggctgatggattggtagggagagacaccatgcggttggtggaaggtacccgtgatagagtcttgacgtgaacaacttagtccaagagttaggagacacaataatgataagtagccgtcaatatatcttttgatccgaatttgaacttattatatgctttacttggcaaatgatatgaaaaacttgttcattgttgaagaatctatcaactattgtattcaatcacttacctttttatcttttaccaatcatacttataactgaaccacaacaatctctctttagtcttattcttgaccaataacttgtattttaccgctttatagcagttgggccatatatatgtaagaatagtttgagaaaaagaaacaaagagagagaggttatgatgagttaaatcatgattaatctttaatatataggtaattgcaatgttaaatggaagtgacatgattgaacaaagcatatttgatgggatgagaaaaatgaacccccacgctttacgactactttacattctctgtggaatgattttgaaaaatataattattacaccaaaagaaaaagagaacaaggcaaaattatgcacatgcaatttattacattcgattcacattgattcagtgactttctttctttcttacaacaaataaaataaacttttggaatcaagttgttcgtagtcttcttctaacgatgatgacacaaaaataagattcaagttgtcttattcttacctagagttatttggttccaaaataaatgaagtcgtgatataatagtaatttggtttcatacttactcactcactcaattgtgtaaaaagccgaaatgcagtaaaaacagtgatacacaattgtatcaaaagataaaatgatggacgttaaatccgtaatttaaatatgttaaaagtaaaaaaaaaagttagatcttctttgtataattacaaaatatatatcataagcaaaggtggaagaaaccatgatttagtataattgccgcaacctcaatgatcctctttataaattaaaaagaaaaacccataattaccaatttattaccaaagcacgcgtctttctttattacaaaattgttttgttttattcttgttagaaacatttttatttttattacaataaaatggaactatagtgtatgttgtttagaataattgtattaaaaaaagtataacgtacaaaagaataaagtgaatgaggaaaaaaaagagaggggcaaaagtggaaaagagagagatagagaaggatggaataattggtaagaaataatcatatggggccaactgaccatggaaaaagatgaagcaaaaaaaaaaagagagagagaaaaagacaattcagagataatacaaaggaatggttttgttttaagagagaaagagaaagagagaactcgacgaagaatgatggtgggaggttaaattccccaaacccccagagctcttcattttcttcatatcgacgatatgctaaatggctgctgctaccattactgatctcttctcttaagctctctttgtttggggc

SEQ ID NO: 5253 - DNA, 959 bp, Arabidopsis thaliana
agctaagctcatgacaaccacacacaaccatatgatttgagtaaccaactaggtgttgttatccgattgaaccgtgttttgcaaatttaattacatgtcaaaaaaatatgaatccgtatgaaatcttttaacgtaattgcatttttttgtcaacttaatggacggtaatccacaaaacaagctaaaacaaagtcaacattttcaagacatgacaaaaattgcctaactgtcattatccgccgattcgtttgactacgcaacatgccaacatgtaaattaatgtaggcatagtcgtcgaatcgtcattaagcaacgacggtcatattatggagaaacaaaataatcgtaattagtactacctctgtttcatattagttgtatttaaggtttttacacacaaattaagaaaacataaaaatctcatttaataaaaacatcgtttattataatcaattcaactaataaaaaaatagataattaaatataattggttaaaaaatattaaatacatttattatttgcatagaaatttaaaaacaacatttaaattgaaaaaaaataaaaacccttaaactacatttatatagaaacagagggagtattattaacgcaaccaaatttctaattagacttgactaatttaaggagtctcctttgatcacaatattttatcttcatataaagacatttcttcattgaaccaaaacaactattcaattccatcatgtgaaaaaataattgtaattagttgtaaactcaaccaccttatcttatcttataaaattcatactagtgtctaagcacgttacttccatattatattgtcatcgactaatcaaatgaatcttgttttgacaatcctttataagtatataaacacattttcttcattgacgctaaaaagaaaaaaaacacaaaactcatccatttggcttctctcttgcatattcgctgcaagg

SEQ ID NO: 5254 - DNA, 270 bp, Arabidopsis thaliana
tgcagaaagagaaatgtagagagatagaagcggcttgagctttgagcttaccctaaacaagaacgtgcacgaacatatgctctttagattcttttcccattttgccctaaagttaactgacgtggcatgtgactttttctctgagatcatggttacatcatctgacacgtgtaataacccaactccacgagattaaccaacggtatgagaaaatcgatttcgattttaaattgggattattattattttcagctttctctggaagcaaca

SEQ ID NO: 5255 - DNA, 588 bp, Arabidopsis thaliana
taggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagca

SEQ ID NO: 5256 - DNA, 41 bp, Arabidopsis thaliana
atcccaaacttgctgattttggactggcaaggatctttgga

SEQ ID NO: 5257 - DNA, 945 bp, Arabidopsis thaliana
agacaaaactattcgttaatctaaacatttgtgatatatgattttagactattaagatcgacagtgaacaaaaattcatgtaagttaaactggttttattgtttattttctttataaattctttaattaacaagtattcatttcagtggtcaaagcatcaacaatagaacaacaactgaacaaggaatatgagctagaaaagtcactggaggacgattaagaatcttgacggtcgtcctcaaactactcatccaagaagcgatctacacccatctataaaatagtgattctttaaacttcccttgagatctcgtttgttacttgtttgatttcgtacatcaataatgatcaagctagatttgatttttctccacaaataagaagcacattgagttaaattttatgttgtaaacttaaaatgctatttttcagttctgtaagaatttctttgggagaagcttcaattataacgtaaagacaagactatttttgaactttgaagtactctcctcacgctgatttttcatgctctcataaatgataaatatgacaactccacgaaaaaaatatgtatataggattagcaaatttagagagaaaaagagagaaaattaaacttggaaatgtgtaaatcaatgagttttgacgaggaattaaagtttttttaaaaagagcaaattactgacaaataatttatcgttatacagaaatcgttaactcttttcttttggtaaggctataaatagtaacttaaacttctctctttgtttgaaagaactagctattgttttgacattacaaactaaaattaaataaaaccggcgtttaccatgactttctttgattgacttatagccgtcagaagagtatgaaccatcctcaatttcgcgttaatatacatacagagattcatgatctaaaactccaaatcaaggaaaaggaagc

SEQ ID NO: 5258 - DNA, 395 bp, Arabidopsis thaliana
catctccaggaaaaaaatattgttgtaatttagaattccttcatttttctgatgaattcataattgtaagatttgcagctgaatatgaaatattttacaggcctttgaagttaactatttggttcatgtaaatttctttaagtggtcaataaaacatccggaacaatggaaccttggttggtagaaggcaacaaaaaaaatggaaaaaataaaaaagtgtatgagatgagattatttatgtggctaatgtcatcggaataattacattggttctccttctctgttattattctttcatctttttcaccaagacgaacgactcttacacgcagagttcgcgagatcagaatcaatggtggcatgaaaaacgacgcttgagctcaaattcgtcgacc

SEQ ID NO: 5259 - DNA, 2000 bp, Arabidopsis thaliana
gacatgttttgtaagtttactttcttttcaaaagtaaatattaatgttaattttttaaaagttgaaaagaaattaaaaagagattttgattctaatctttatagaataatgggagaaacgatgacgcgttatgcaatattaccatacaagtcaattcatacgatccaaactcatcatttatcaattatcacttgtgtcgtcaataccagtcaggcagtcacttctaaactttacaaaaaaaaaaagaaaaaaaaaaactgttgatcagttctttactacaaaagaaaacgtcaactagcgacaaactttgatctatcgaccatcattaagcgctcgttgctaaacaaaaaagtcgatagatttgaaaaatctcccgtatataaaatatgttgataaatataaaataagtttatttgattcattgcatgagccatgattaacgtcgacaacctttttctttcttacatctgcttaaaaaaaaatcacacgcactgagaagttagattaagaatggttgacaatttatttatttttggtataaagaatggttgacaatttatttatttttggtataaagaatggttgacaactaaagcaaacttaaacttattcttttcgaattacgtatgtactatcattataaatatattctcgaataactcatatcaaatatatatttgaaacgtgtataactaacattcgagattcttggtttgacggcatatagacaagccatgcaattatgtttttgcagcgaatcaaataatcttatttcttataaaatctaaagaatatatagcatagaaatgtaaacaaaaaccaaactctatatttatagtctctcctggtgtcgagaataacttttttgagtatattctgcacaattagttactacttactaagttactagtgagtagtgatgcacaataaacaaattctgacagttaatggaatagaaccagcttcacttagttatacgtctctatcaactatgaagtaatagaatacattcgactgcgaaacattatgaaatctttttattttctcctttctttcgtttgaccgataaaaccaatggaatgaatataagaaatttcgttttgtttctgtacgtggtatatccactgatttaaacttttaaatttacatgcacggaacttaaacacaattgtatattgtttagatttagaatataatccagttgtcttgttggtctaacatattatatatattaattaacccaaactaggtacataaacaatttaatatcttaaaagaaatactattatggggcggcgggctgatcacaacctttagaattagagaggtaagacaaactcacttatatagtcaaaagctattaacacttccataagatataaatctctcaaactttggacagtctacaaaatacttcacattttcttaataatcatattatatgcttttgtgaaagcatataaaaacctgatcatgttggttttacagttctgacaataacaacatgttttcttaacttttttgtagctgctagcgatcaacgaccaaactaacgaaaacaaccaattctaaagtttgttgtttgtttatgtggttagtaattcaataatcgaatttggcaaccagttttggtgactgatttcatcaactaatgactaaaaattcagtctataaacattttcacgtttcatattttgaattaacgttaatcactaaaattatttgatttttttgaagactacaaaacaaacataatttagtacatgtacttcaaactaacacgaccattagaaaaacctttaagagcaaaaagagccggagacaagttaaagcccataatagttgttaagttatctcttcggcccaaaaagaaaaaagacaagaagtatgtaattaaaacgacgtcgtatcatagttaaccctacgagaggaagtacattagtttggagaagagtaatagacagagagatagagagaaagagaagcagttcggagaaaca

SEQ ID NO: 5260 - DNA, 2000 bp, Arabidopsis thaliana
gctcagacaaaatattgtactggtgtttttggaaatatttcccaccgagaatagatgtcacaccagaactttcaacttttgtgtgcgtaactctttgcaaagtttttcgaaaaatccaaccttgtttttaacatgtttaaaataggacctcagatcaaggtcaagtgatcagatgtgtaggttatgtgtgtttatgccgtccatgctctgattcaacattttttgtgtttacatatatcaaagaggccatcccaataagcaacctcttttacttttcatgtttagaggaatttattgactacgtattatttcattgatttggtcatttggaaaatccttgaaagttttcgatttttattaaaaaaatgaatattacaaagctaaaaaaatggaattaaaatgatatatgtaaattttaactattatttagaaatgcgttcgaaataacaattttcaccctcatatttgaacttttgtttttccaacttgacacatatctgttaaaactcacaaactgataaacctccttgaatttttttaattttttttctaactattgcctatgttttctgttttactattgacgtcaactataatcttgtatcttgtatcttactgccttttttttgttattaccatataaaatgtgagaaaagagacactgtaaaaagtaatagtacacgagattagcgacactcacggagtgtaatctttattttaaaaaatctttgacgtccacagaacacacgagattaacgcaatttcattacttccatttttaaagctttctattaatatattgaaagaaatcctctcttacaaagcgtcgtgaatgaaatcgcaagttttttaattacattaatgcatgatatatcatatagtataatctaatcatcctttcgtaatcagtgtgacttcacttaactagcgtacatgcctatctatagtgacagtaaacacggttaaaaaatttgttgtcttattaacaaccccacactagctagttgtggatctgtaattttctggcttggcaaaattacattaaacattattttggcactaccattaatatatcgaaggaaaccaagacacgcacaggctccataatcaaaaattataaaactatatacaaattaatgatgatactacaccaaagtatatattcgaagcaaggctagctaattgaactgaaaacatagtcagtgtagtttatcaactttcaataaaaacatcatccatgatgtacatgtgtacgtgtatactagaagtcattctgcatgatgattttttttaatatacaaatgacacatgtccgagacatttgacagctacgttgatatgtattcgtttggttgacagagcttgagaatgcatttttttataagggaagatttaagtctatattcggtagaatttaactcatagacattactcctaagtttttgtttttatttttgaaaaagcattactcctaagtttcatgtaatatacaagacggaatgatggatcaaagttggttggccaaaaacaccgaagcaagcttgtcgatgccttttgtctcgactagtattattgttactagcttgagactaaatctgattggagtccacacaaaataaatcaatattatttattaatggatctgttttggaaatccaaagacaaataattcatatgtatatatatatatctatagtagtattcggcggtcgacagtcgtaaaccttcacaaaaaaataaaaataaaagacagtaaactaacaaaataccaggtggtctgaactctatcttatgaaaaaaaatattgaatcgaattcttaaatgtcatatatattgatgtcggaacaatatttttttattgaaacactaaattcattgaacatgttgggttcagtccggttcagaaatttactactgtgtctttataaaaccaaattactattgtgcccccattttccgatcgctataaaaaaaacctaattcctcaactctaattcacc

SEQ ID NO: 5261 - DNA, 1135 bp, Arabidopsis thaliana
ttcggaaagtaaaacattttttgcaatggaatttaagaatcaaactttgctactactactatgttaaaactaggtctaatccagcttgtatacacattgggaatgagttcaaagttagggaatgatatttatacttgttgtttttatatttaataaaacttgcactcaaaaacgctaagaagctgcatgttcccatctgattgttaagtttctactagctgattcctattaatatccatatgttagtaaactaaatttaatttatattttatataggtggaagaacacgattatggagctaggagtcaaattcctgaaagactggagaagattgtgaacagtgttcactaatattgattccttgttcctttattaaaaaaaaaagttctatgtttttgttccttttcttgaattatttttggtgttagctagattccttttcttgaattgtatcatgtgctgtgagagtgatgtttcatttgtaagcataatatatacttttctctacttaaagctgtgaaatatattttgttttttggtatcaacaaagctgtgaaatatatgaaacttaggatgatgattttcaagaacgaaaccaaaaaaaaaagtttcttagaattaatacatgaacgagcgaaataacttcaccttttttcaatgtgttatacttgcccaagcatttgtaatctagtgataggagaaactttggtgataggtgaaactctcagatccgagtttgaatatcccgtggtattagttagaaaacatttaaattcgggacagatagtgttgtggtccttcgggaaaagtttacttcggagcactttggtgcgtttctatcgaagctgaccagatcagcaaatagagtttatcaaaaaaaaatgtgttatactatttcaaattgatgaatttgaattctaaatttttattttattttatttttttctcaaagtcagaaatgaaaaacatgatttaagacttcaagtgttatatatgggttttgaagaatactaaagcccatgagcccaaacattaacaaaaatgtttttttcttgtaccttctctcttcaacgtagactaaagaattagggtttccgctttccacacacacagctgcaacactatcttctcagaa

SEQ ID NO: 5262 - DNA, 2000 bp, Arabidopsis thaliana
aacactgttaattaagacagatttttttatcactaattaaacatattcttgtcttctctatgattatgaacatataaaactactcacaaaagatgatgcttcaagatttgattatttcttagaatatgaagatggattaattgcgccaatatcatttgaatattttgaaaatacaaagttgaaaatggcggtaaacagcaacaagaaaaagacaacagtgaagagacatgaacaatttgaaaacgcaacaagtacggagtttatatatatgcatgaagaacattggataatcgttgaaggtagagagaggaccactgacacataaaactgagatgtgattaaagaagaaagaaacagtgatgagatttaatccttaagggtttttttttttctgtgaagaagggaagaatgaactcatgaagaagaagaagaggaccactgttgcaaattccatcccctaccacagttggcttatgaagtttcagcaaaagacatgtgatatggtatggtttctgacttctgagtgaacataagcaacaaatattcaaatcaatgggcctaaatgatcttgcagttttggattataaagttaagaattaaaaagaataggtgatatatgtatcataattttaagttttaaacaagtatgtcagacaaaattctacattctaattttatacatagatatgagataacctcataaccataaactacaccaaattttcatgaacaaaatatgattcacacgaacttttttctatcttgatcacctagctaacttgacaaattagttgttcgtctaaaactacacaaacattcaaagttcgttttaaattcaatatatttaaaaataacagttaaagttttattaaatggcattccaaatattgattccttctagaaaatttgtgtggttttaaattgtgaaatttggatctagaaaaaatagcaagtgtggtttcttgtgacctatggttgttagtgtagttgtataccattttttaaagttacattgtaatttgtaaaccatttttgtgtggttgacaaaaaaaaaacctatgacaaaattgctccgtttttattttcaataacaaattataatgtaaattaatatgtatcatagtgtttttaataaaaatatttaaaattaggattgattgttctgaaaaaaataacgcaactaatactttgttagcaaatactaacgtttacgtaccaaaaaagcattatgtaaatccattcatccatcattgtatacttgactttctacattattcttttgttgtatcaaatttaaaattaatgaatgaacttgacataataaaacacaaaatatatacttaaattgtacgatataaaagtttgatttacatattttatatctataaaaaagggtaaataaatgaaataaaacttttttttttttttttgtcaaagaaatgaaataaaactcaaattacatttttatgtcgtaatgcgagcacacaagtgagtgcatatccagtattaagttttttttttaataattcagaattgaaagcaaaggaaaaagaagaaatcgaaatcggaaactgtatattgttgttcttcgattcctcctcgctctacgccgcgtcctctctctcaaattcatcggaagcaaccttcttctcccatcatcgcctggttcgtttctaaaccctacttcttctatttcacagtatatcttcctttaattttcaatcgaatctagctttgtgtcgatctcaatgtagatcggaatcaagtaaaagaaatcgatgaattccaaaatgttcccgatctattgcaatgcacgaatcgtagaattatcacctacattagtcttgatctaatcgccctatttcaatttcaaattcgacatcgaagtttaaaggagatcgcaaaacctagttatagaatcgttgcgtttgagttgtttcgctggtgatgtagaaaccctaattttggttgtcctgtgtttggtacttgctcagaatcca

SEQ ID NO: 5263 - DNA, 2000 bp, Arabidopsis thaliana
ttttaagactatgtagcttagcctatgtcaatgtcatcaatctatatgcaatatatatagagcctcaggcacataaaccgtagtccccatataaaaaagggaatgaaacagctaataactccatagagaataaattcacattcaaagcaaattcaccaccccaatcttctcaatggttcggtttcttttttcaattcttacattgtactaaaagctaaaaattcagactgatacgatacgaataggtttttgaaaatataaaaattaatcaatttccattaaagggctgaatagctaaaaactccatagagaacaagtcgctttattggatttagattttaaaaagacggcgctcgtgaattattaaagtttaaactaagataagatttaaagagatttagaggagacgtaatctggtgtatatcgttcacatagagtcacgtcactgtataatccatcgaccactaaggttttagagtttagtttcaaatcttactttttcatgcaggtgtaccgtatgtcacacagattatagtagtcgccaacttacgttcccaatgggtgataacggcgtcaacgtcctccgtcacgatcgtgtcgtaagctgtacactgtataggttccgtgaaccttaaaatcggatttggaaagctacgtacgtacgtaaatattggttaaaaagttcaaacagttttgatctctcttttattacaaacaaactgtacttccgacaattttctttctttctatttcaagtacgttttcgtgtctaactatattaacatctaacttctgacttttatactctgatgggacaatctttaattcttaaattctaagttgtaccatgcgaatggatattagattttgtcagtacaattgctgactatgaatgaagtactctaacatcattattggttcctgaataatgagtacttaaacaaaacaaatttgaagtaacgtaaccatgacatattagatccatgtcccctaaaacgtattaaaattatttccttacgtcgttaaatttcgaatctagtgttaaattgttacattggttgttaaactaccgacccaataaaaaaaaagaaactaatatttatgattggtgcatcttgttgtaaattgtaatcgtatggcctaccagcgatttcattgtccccaacatacagatatttttgttcgtgtgttataaattagggtagaaacatcacatattttacagagacaaagaaaaaaacaagaatcgtaataaaatgatattatggatacatgtagattataagatgagaaataataatttgtcacgggtccatcagtatactcgtcaaaattgattaggtaggtaatttacttcacatgctcttcctgtatacaagtataaagtatgtattttcatctaaaatctactcttttctcaattacattttatatagaaaaattcatattcttaagaaatagtagtaaaattgttcttgaaaaaaaatatgaaaaggcattttccgtgactcagcctcacaggcggcttaaaacgacgtctttttcaattttaataaatttttggtaaaaaagcttttggatccgccgctatcttcagcaattaaagttggacgcagaaactcagaagcaaaaagacgataaatattcatcatcaccttcatctctctcttcctctcatcagacttcaccgttcttctttctctcttcttcatcttcagacgaaacctcctttacttccccttcaaggttttatatttcccaaatcctacacctgctcacatctcaagctcaagttttgttttcccgggaaaagtgacacaaacaagaacttaacaagggagaagaaaaagcttatattcatatcaacggttgacgttggaaagctattaagatttggttttctacaaatttgttcttcctgaaacgtcacgagacagagcttacaagaagagaaaacagaggaaatttcgttgcattttttttacatattgattcgatta

SEQ ID NO: 5264 - DNA, 1352 bp, Arabidopsis thaliana
tgtaatcgaatcgttcactgttttaggattgcgcgagtcttcttcttcatattggaacatccacccgacccaagttggttaacccgaccaagattggtattaacccgccctgtaaacttttagctaaataagcccatttagagtctagaggcccatcacctacaaatgttttcaactatgaatcggcctattgaaaagaaaaatcttttgccattagaaagatagaaattcagggtagcagcaacattattgttacatttaaaagttaagtcaccaccaagcagtgtgtcttttagtaattgtcttgtgtcaaactggagcataagtgtatggatacaaaaattagtattattgcaatatgattgttgggtcacatgatctggaaaagtaaaagcagctcattatagggtactatgtattgttaagaggctttgggttttagcactcatatgcgttgacgaatgtcaacaatctttagttgacacgtggaaagtaatagagacccacatccacatggaagcagttgagatattgacccaaaaaggtacacaactaaaactctaaaaacacaaccccaaccacttggcatcggatctctcacagaccggtgcggttgctcacctgcattcacttctcattgtcctttcgttttgttattgtacacatctatctaatctatctattgttccacatgttaatgtaagtaaaagacaacacaataaaaccaaacaaattaagctctaaatatcaattatttacttacttttaggttgaagatgctacccaatagtagttgtgatatactactcataatgagagagaatttggtatatacaaaggcaggcgagacaggtgtgaccggttgttgttgatcttaattaggttaccattataattaacccgattaattatatatcctctgtaaacaagtttggttctcattttttttacctgaataactgtgattaagtcaacgagcattattgttgcatttccttgtgtaataatgagccacattattgttgcatcacacacttatgctaataaagaaaacaggttctacacactagaacaaaaaaaataacagcaaaaagatattagcaaggtaagcataatttgatcatataacaaaagagaaacgttatgatctctattagacagcttaaccaacaaagctaaccccactttcctcttcatatttaatctctctttctctcctttcttcaacaaatatctcctgctcttacatctgagtctttttctttctaaccttctgattcatgagtaatcatatgtccattatgaagttcttgaatcaaatcctctgtctctctcttatcctctccatatcc

SEQ ID NO: 5265 - DNA, 583 bp, Arabidopsis thaliana
gacctaaaccagatatacgatgtacaatggtagtgatcggatttaagtagaagaaagaccgcgattgaaaaactccggtgatcagtgtcgccgcttaccggtaaagtaaagagtcagacacgttcgagttattttgacttaccattacagcttaacaaacactaaacgctgtcgtttaaagcatcgttcaattataatatttgtttttgttttttgaagccaaaaacttaattttcaagttaagccctaaacaaatcaagttccttaaaatgttattttctaaaaaaattttgtttttttgtctgaattaattggttgcaaaaaaatttgatgcgaatatgcgatataaattcaattttcttgaatttttgatttgtagttttttctggaagaaaactaattttaatttcgtgatcctaagaacagatagacacgtggcgctctagatcgccagaagcccatccgaaaatacgatacttggcaagaacaaagccgcgccaatccaaaagcccaaactgagatggcactgcttcaatccaatcttcgtcttcatcatcatcatctccattaaagctgcttaaga

SEQ ID NO: 5266 - DNA, 412 bp, Arabidopsis thaliana
ccttacaagtgagatcattaggtgagtttctttcgaatatccatataagtactgtgaaagtgaaagcttcttatgtaacacctctctacgtttttttttgtaatatataagtctttctaattcagagactcgtattaattaagcaagtttcttaattacgactttgttaatcacggacctttggaacgaggtagaaggtcttgaacatgtgtggaacccaccaaaggaaaaatatcagtagattcaggagagttgttaaattttgcctccacgagtttttttcttttcttcttgttgagtcgtttacgtcacgtcgagaattttctcttttcccgagaaaattaagaaaggatcgtttgattttctaagaagggaaagataaacagtgaattagaaagagaaggaagtttca

SEQ ID NO: 5267 - DNA, 2000 bp, Arabidopsis thaliana
tatataagatccacaatcttttgttttctgttaaacgatttcagcctaatgatttgacaaatgactaaaatagtttcaaataatttgaatcgatagcaaattattgtagattaaattcggttttagtccgataccatttgctgccaacacatcaaagactaaactatcaagatcaaatgatcaaccattaagtatgctattctcttagctgtaccacagtagaaatgtaaagtcattttaaattgaagcttcatacttataacttacgagtattaatcacaagagaagagagagagactatatagtctatagtatatgatttttttttttacacagtctatagtatattaatatgttttgatatgaagacaaaacagcattgaagaggtgaaataactgaactacaagaaaggcccaacgaacaacttattttcactggcttcagctgtcattcttaatatctcagagagatacataatgccttggatagaataatattgcttctgttcgaaatctcgtgatcatttaattttcagtgacaatttattttccaggttttagggtgtttatagttcagtatcgtcaataaatgactaaaaactctaatctttgaactagctagtaccatttaaagttgcaatgtttaatatgaattcgcgatttgtaaaaattatatgggtcttagttgtttcttattttgcttagaagttaaaactgtgtatttcaaaaccgacactatatataaactctaaacaagattgtaattgtttgatctcttatgtatcaaagaacaaatttgacatagatcaatttttacttaatacatctactcgactattgtataactcaaataaaaatatcattactcttgcctcctacccaaaacacatctgatttgtcatcctcaccttcttcctgagtaaacaatttccttaagaaacgcaactaatcaccaattaacttacgagcttcgagttttgtattaatattacttattacatcatcatttctcgagaaatactgtttactttatggatttgaaagatttttttaatcttccatattaatctttttgtctcccaacctgtcaatttaatgcatttacatgttctactaactttggcctttgggcgcagccacatgctctgcatgctctcatttattgcacttgtagtgtatacatatatgtacattaataaggtgctatttatacttaacattttcggtttatttctttactttttgtcaaaaagtttatagagttttggattatgagaactgattttaagcattttaatttgaggtatactctgcgtacgtaaactgacggaaaatacgtttgtatatcaatatggagaaacaaaatgtgagtcgagtcttttggtgtgtaaattcccatgagcgccatttttttacttcaccaaaaatagtgaggcaagaaaatgaactttacacttgaactttacatctcttaactctaatttttttatttgacaagaaaaaacatacgatcaaaattgcatggaaaaacgttaattaatctcattataatctccagtccattttataaccctcctacctaccacaaagaatccatcgacgaaatagagtatccgatgaattaatccatatctatgccaggaaattaccgaaacaattatagacatatagaagaagatagaacattacaacatgcatatatcatgtcaaaagtaacttctaactaatatcagtgatttacaagagaacaaaatggatttttttttatgtatacataagagaagtaaattgtaactcttgacgtggagggatctgcatcgaacatataggtgatgagatggtccaacattcatttataacttatccatctgtcactctataaccctaattttaacccttcactcttctatataaatctcccccaagtacttaacactcttcactactctctccactaaacaaaaacactagagttaagttacatatagagtaaggaagag

SEQ ID NO: 5268 - DNA, 774 bp, Arabidopsis thaliana
gtaagcattcaataaactttctcaagacttgtttgaaaatcatattatcaatctacattctacacttatttgaaagataaaatatctccttgtccttttaaattaatgttctaatatcgtcgtaacgaatttggtctgcaacgttttatatgtagaaacaaaaactgtataatagttatagcatgaaactttgattaagaattagtagtggttacagaggattgttgtattacagaggattaattttatgaacaaaacaaaaagaaaccaatacagtagaaccgaaacggtctaaatttaaatgtttgtgtatatgtgtaactctaatgttttgagttgtattataagtgtgttatgcattcgagttagttctattagtttcctataatttcgttacaatactactgtatctctctgtcctcttctcttctttgctttcatttttttttcagattcagttccatcatcacaacaaagaaccctaaatcaatttcacattacgtttcatcaccaagaaaaaaaaacggaaaaaaatcatttattacgtcttctacatttcttgattttgttttggtgtacaaaaatggaagagatgaaaaaggtttgatacgattcgaatattctattgctacttctctagcttccagatattttcttctttttgattttgtttcatttactggtgatttgattttattattgtggacaaggtaacgtataaaaagtgaaatttttgtgggtctttttctttgattcgctaatcttttgagaaac

SEQ ID NO: 5269 - DNA, 2000 bp, Arabidopsis thaliana
taggcgggtgtacccgaaattttcaaatactcgaacggatataaactttaaaacccgaaaaactcaaacccaaacccgaataggtatgcaaacatatctcaaatataagtatatattagttatatttatacttatatatagaaaatattagaatttttttggatattttagttatttttgtgtatttttagatatattcaagcaaaactactcatgttgttttgggaatttttgaaaatttcaagtaatttaatagatttgcacacaaaatttgatatttcaatatataaataactcgaacccgaacccgaacccaaaccgaacccgacccgataatatttttttgtttaaaaatacatacaaccaaaatcttatttctacccaatttctttaagtaataattatattaataaaacctacagtctaatttctacagcaataaaacttacagctacagtcatcacacctacaacaaaaattctacagcagtaaatctacagttacagacaaaccaatcacccacgtaatctcgtaagttaattttacatcatgcaaattaatattaaatgagttaaaattaataaatgaaaataattgaaaagttaaatcctataagctaagctatttttctcaaagtgttctattttcacttatgattacatgagttaaagacaaatttgttaattttgcttttgttgaataaatgttaattgtttataaatatatagacatataaattagtatatgtaaatttgtttactttttaagattttctatttttttaaagaataaaaaagttaaattttgaatgacacatgtaaacatctaatcgtttgacttgacactgtgccaagtcaattttgaaaaccatactttatataataagatatatatatatatatatattttttgtcctcatagttcaattgtatatatctcaataatttttttaatcagaaaaaaacaaaatacatatatatccactaattctgatttgataatgcgttcacacttcatatttatcatgtttatcttttataaagaaaataaattagtcaggtcaggtttttagtaagatatatgtttatgataatatctaaactcgaggagatgataaaactaatattactcaggttgaaattaaaatctaatgcttataaggatgaaatgaaacaaaattcagggagtaaaaagatataaaaaaaacttgcaattgaggtctcatattcttaaaccttaccaaagaaaggcgagattaattaatcctagttagtcaagtaaatcatccaattagataagatcacgtgtcggtcgatgtacgcttgaatcctcgtttcgatacaataattgaagtgtgtcatgcagagattagagagatgtgtataaatggctcccaagtctccaccgcaatatccaacgcttgaccgattccaatcagctcctctcgatttccgtttgtcggaaaatctctcccgtgatcggcgtattgtgaatgccgctcaccgagatattctccggtacgtccgcattgatcaatttcgtcgcgtggctcactctgtttcatctgttcttttcttattttttagctatttttgttgagatttgttcgttgaaaattatggttttgtgaaaagaacccaacttgttttactgaacccatgatgaaagttataatcttttgatctggttacctctggattttgattacgcatacagtggaacatgcaattgttattagcattggttatagattggatttcggttacatgccattggatcctttgcaatgtttagtttgtgttacagattctctggaaagaaatctttttgcatgttccgtttgtttcgcatcctcttgatactgttcgatcgatcaggctacaggtttcatcagtttcttctaaaagttgtaagcttctttttggtgtgccagattcttttccccagtgaggacaagtgttcagttgacttattaggaggtggggtttgaataagttaca

SEQ ID NO: 5270 - DNA, 1953 bp, Arabidopsis thaliana
gtttgtcagctaaaacttttgcatttttctcatataagtataactgcaagtttcatacgagtcagagaataaactatctgaaacgttatttcaggatggattctgcaatcttgagagaaggcgctcagcacgggatgctgatgaatgaagtttctgggactcggtgtaccgtaggaaacttggaaggggtcatatatgaaatcacacttcaaaagaagagaggaattgtgttcgagtaacttagttcctttgatacctcagaattttgtaacattatttttatgttatttagatgcatacatttttggtgaaacgtttactaaagttacagttcaaaaagtatacaatgacatttgtggatgctttgaagtgaatccacattgttagctgaaaaactgttgcaactatcatatctcctttatgatagttgtcatgtccaatttcttgacttcacctacttatcagttttcatgtatatcattctttttgttttccacatcaatggatcatctttatcctgcgtgactttaaaagtaaatatttttcagtcttattttatcttctatattatttttcagttttttttttttatcttttacattatttttcagtcttattatatcttctatattattttcattcttatttttcttttgtcggtattttcattcttattttatattctaaatcatttttcagtcttattttattttccctattatttttcagtcttgttttatattctacagtattttcagtcttattttatcttctttgtcattttcagtcttttttatcttccatattattttcagtcttattgtatcttccatattattttcagtcttattttatttatctcttacattatttttcagtcttattttatctgaaagtgtcatttaggtaggtgcagactgaagatattgggactttagttgatattcgaaaaaaaaagatattgggacttaagtttgcaaagttttactactatagtaatatcgtaagtacgtaaaagatatattttactaatgttttaacaaatcgtttaatatcataaaataaaataaccatgttatttatttttggggaaagtatttaataaaaatacaccacataatttctattcccacaaaaaaatacacgatctattttttcgtaacaagaaatataggcttttttttttactcattttagtatttaaagtttaaaccaatattatttatttaaaacaaggactaccacacaccacttggttagggtcaattttattcaaataaatttccaccatataataacttaagttacactatacagtttactcaattaaaaatttgttgtccaatcagtaaagaaggaaagaaaaaaaacatgttataaattgattgaggtctaaattaaatgttggtcatcttccaactccaaaaggacccctcccaaccagaattagtggagataaacttgacgcgtcccttcttcattctccgtcttcttcacgtcaccggaaaaacgacgaatctcattgcctgagattcttcatcggaattaaacctccggaggaattaatcacggtaaatttcagactcttcgttatctcttacgctgatcgaattcaatagaatgttagggctgatcacaaagagcgatgatttttgcagcacgattctgttctaatcggagaacatttttcctaattttgtgaaattcatgttgaatttattgattttccggataattagtagagaatcgattttggaatttgaatgataatttgtggtatatttgaacatattttttgagcaatggacctgaccattttctccagagaactcaaactattgctgaaaaatgcaatggaatggggtgagacgagcccattctatatggtgcaagagattaacaaacaacactcatttgcatcatccttctattccagtctcacattttttcacc

SEQ ID NO: 5271 - DNA, 595 bp, Arabidopsis thaliana
tttcttccgtctcctcctttccgtctgataaaaatccgatctttggtgcgaccaaatcaaatcgtggagcctaatcaaaaaccacatctcatcatacccggttcggttttcttaaccgaatcaaattatacataaaacggattaggcttctccggttttcgactgcgttttgtataaaacctctcaaaaaccttttcttctctccccgtcagaccgatcttctctctcctcgccgccgcctccaaatccggaagaagcttttttccacctctattatcgaacttgctttataaaaatctaacctttggacctgactttccgacttctctctctgtctagctgcttctctcacccaggtttgccttcctctcaagttgaagctgcggctttattagtttagctattgactctaagaatgttacttgaatccattcacatgagcttcttacgtcgttttcattggtttagctattgacgttgacttgggttttgcttgagttcattctctattgtggtctaccatactttttcatgttacttgattgcatatttataaaacggtgctaaaagtattccgttttgtatagcattctag

SEQ ID NO: 5272 - DNA, 639 bp, Arabidopsis thaliana
ttcaagttcacatttttttttgtcgtgagagattgaaatgtgatcagtcgctgctttagctaaattataaaggaaagacatgattcaaactacgacgtcgtttatactaatgggccaaacttaattaggcccaaaatgatttatttttctaaattagcgatgcgttttaaaaccctaggttacaaaaacgcgccgttagcaataaaaacgcagcgttttgagaatctctgaaccttcttcaacaactataaaaaccatcttaaaccctagcagaatcgcggctcctgattttagctctctctaaagctgtagttgtgcgttaaccctctaaggtactgaatctctctcgccctctctttcttcgttgttatggcaaataagcttccaaaattctaagactttgacaaagtatagttctgttctttgtcggattttcaagaatttgaacagagtatctgccttaactattattctgatttgtaaacttcgaaacagggaaaaagttttaccttgaatattgtttcgtactagcttaatggctttagctcgtaaaacactaacttgcaagtttggtgactttgagttgattcaagggtttctcttaatcttgttttttcttcttttcaggagcttgtaaaa

SEQ ID NO: 5273 - DNA, 2000 bp, Arabidopsis thaliana
tttttaatcactgaattaccataaatttgttagacatttttacatgtttcttacagtatattagatagactttgattctcattctacatctcaataatatataatatatgatatgaaagttggacagtaatgaaatagtaatcatgaaagtgagactagctatttaaatgcaggtcacatgcaaacctcgtccctgatcccatcaacagaaacatggccagtgtactgtgcaaatccacaaactcccaaacaacgacactgtttctaaatctataatgcgttattcttttttatcatggccaaaaagtttgtgcaattagttagctgtcttgtacgtatataataatagaaattaatgaggaagtatatatgttgtgtgttttgtcaagtctctacgggccacgtccttatccataaaaaagctttgtgcatgacaagctgtgtaccattttcctttattcttttgtctttctacttattttctttcaatagaatataaaggtcaaaacatttgaagtcttttatagtcaaagatcaaacattgaaagtctttcagagtcaaagatcaaacattttaagccttaattaaggttaaacattacatcgacttgttaaggatttgatgatttacgagcattattaaaccgagtcgagaaacctcactagttaaagagtttattttgtgttagacgtgacgtacatgctgcatgcatatatgtaatttaagttgtttgcggcgagaagctgattttttaaaaattttgagacataatgttttaacttttaagctttctcaaacacattatgttcttgatgtatgaacgatagttttttaaatctaatttaacattaggttatcagacacactaatatacatgtaaaactttgcattatataggagccgtgactaccctatggcaaaaaggcaaatgcctaaagccaaaaaaaaagtttaaattaaaggccaaatttttataaaataataagcttatcaattttgttattttgataacaaataattgttaaaatgaaacttttttcgtgaaaattatattcttaactatacctttatctatagaccattttcttatcttgaaaacacatcatttagtaatatattttttttggtaagaatcatttagtaatacatcataattagtaaatataaatatttaaaacaaataacattattagaaaaacatataaaaacaaaaagaataacgtattattgatttttttacattgtaagtttttgatactaatattttttccgattcagtattatgattatttttaaaaactatgatgatagccacattttataaacttgtcctagccctgcacacatctaagcaagacactgcattatatatagagttgcttgtgtgtgttttgtcaatatttttacatgataaaatgatgatgcactctgaatacgatcccataaatatagaagtttaaatctaaatacgatcaccatatttacgtataaaataccaaagagtgtagaagataattattttagttttatagaataactataaaaaggtgatataatccacaatattatcatgtcaatatcttaagaacaatttgaaaagctaaattattggaagaatatgggattatggagcagtgagagacgtcaacttacaaattgagagagaaaagagtttcaacaacttttttttggcagtgaacttagaccgaactaaattccttcttcaaaagtaatccacaaataaattaatattttatagcctcgttttcaaattaaaaacagagagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctctttttctttctctctctctttcttgttttcgccggcgatc

SEQ ID NO: 5274 - DNA, 457 bp, Arabidopsis thaliana
aaacgatcggacggctaaaagttctcgatccacgtgagtaagtgaggtgatccctagatacgtttccaaagttttaactacggtttgtgtactttgtacgtttcttttggttattgaagaagatgatgtaaatgcaaaaaagaatacaagaggttttttgttcacgaggcccatttagtctattcaagcccagtaaaccgttattttggattttatctagcctaaacaatgctcgcctcacaccgtcgagtggattcttggccgttgatcttgtctctcacgtggcagtatcgtagtcgaatgtacatgatctatgtggaatagtcgatattatccctcttggtgtgagtttggtagttgatgaaagcaaaacatttacgtaacaatgtctataaaatcagtacaggtctattcttgttcactagcttcgaaattttagtcgaagaaacaaaaaaaa

SEQ ID NO: 5275 - DNA, 2000 bp, Arabidopsis thaliana
tactcttaaatgcaactgaacgggctttactatttgatgcaatgatacaaagaaccttcagatttaaacaatgagacgatcgcaacacaagagaataatgttactgatccttctacaacaaacactgcaccaaggcctagtttgcttgattgaatgaagtatacaaagcatagacacttatcacatttaaagtatttgtaatatggcaatttcgtatgtgttaacacatttctcaaattttaaaaatcgtttatatggatcttataaaatatggtagtaataatttaggtgggggattgggtcattatttatttctcttctattttgctactgcattaactaatattaggctaaaagttccttaaataataaagcttttttatgcgtaatgtagccgccctcatttatataggtctcaccaccaatcgattaattgtaagtaacagaaattgttgattatagttaaatgagtcgttgataatttgtttaaatttgtaaactcttcaggcaaaatttatattatgtgaacaaaattgccatatatttcatatcatgaatgaatttggtctaaacatactccatactgtcaaggtttaaaaaacattatattcatacaatcataccatgaatgaatttgtgtaaagctgtaaactcttcttgcatcctagctattttcctcttcttcttttttctttttctgactagtcatatagattttttttttgatttttatttgatcgttggagaatcttcaaaagatgactccactcatcttttcaaaaactacctagaccatatacagggctctccgtctacaacaattagcgtccggaaaacgtaaagaagtctacaacaattagcgtcctcgtggatcagtatcgtgacatttgtgtcatggaacctatccttggcagtcgaagttaggctcactcccaacggtctaacttctaagtgctcactaaaatatgaaaaactaatgttctcgaacaaacaccacctataatgactcaaccctccataaaattcgaaaactgatcttaaacaaaaatatatataagtgacgtaaaacataaatttatgtatatctattaaataataaattagtgaagtaaaacataaacttaatcgcataaaagtttaactttattttgcttctcaatagattttgactacataatagacgtggattttagtcaaacacaagcgatattgcaaaatttccgatatatatatatacacgtctttttcactaatagaaaagtaaacatatcagctcatcttttctctattggcagttctcatcatcttaattgaaaatttatgtttccactttttttagcttagatacaaactcaactttgtaaaagattttcttgttgcatattaaattttacatcacaacaaaaagaaaaaaagaaataaacaaaggagatcaaataggttgtacataaattaagcaatcatacaacatcaaatcaacagctaaaaagttcagtacaatctttacttccgaatttacttcattgtcttgacatcatgttctaaacaaaaaccaaaccaaagttctccacaaacctgtcggtttttaaccaaaccaaagttactagcttaattcaaaaaaaaaaaaaaacagaactgattcagaaaccccaaattgacaaattgtcaaattgtcaaaaagtggtcatctttatcctttgacatctggttagtataaaaaattgtaataaatgcaaacataagatccaaaactacaccttattagaacggaggaattaagagtgacataactcactccaactacgaccagtacaagtagttggcgacattaactacctctcaccaaccaccaaacccaatccccacaatattaccattactctcatataactacacatattcatatttacattttttgccaacacaactccttataagatatacacttcatcaacctatagatctcactcacataatcaacctacaaaacaaaaacaaga

SEQ ID NO: 5276 - DNA, 402 bp, Arabidopsis thaliana
ttttctttcctttttattttataaggaaagtataaaaatgaaggtacacatattctagcttttgagaggtcagaactcagaagtggatggaatttgatttggattgggttgggattacgatagttgctgccaaaacctttctagtggaaacaagaataagctacatattgtattcccttatcaaactttagttttgtgaataaagtgttacgaaagtgtaataagatagatgaaaaaaacaaaagaggaaaaagtaggagataaaacatgatagaataaattcttgatcaaacccctttacctagggctatatatgtacacatttaatagcttttctctgtcaagttgaatgtactgatcaagataacaaatttatcaaaaataaatacatcatactggttt

SEQ ID NO: 5277 - DNA, 2000 bp, Arabidopsis thaliana
ataacattaaatatctaataaatatgcctatgtaaattttataagaaagtgaatgccgtaggcgagtgtttctaattctatcaaataggcacggctcttagatatattatgcatgaatttgaatattcacatataacaatttaaacatgaaccacgatgcgaaatgtcttaacgctaaaattgcaatgcttttccaacataaaaattaggggagaaagcagaaaactttattaagataaggaccttttatgctatatgagcctatatatgagagtatatttaaagtctatatatggtatgcacatgcaactgcatgaataatttgtatatctagtgattaatataatatattaaactaaaaccatatcttatgtgtttttggcaatgtaacttcacatgatctgcgagcatcttacaatcattgacgtaaagtttttgccttgattaatagttgttgttatattttactaatatatgttgtttgctgtgctgttgtgcatatactattatagctgcatgtgcggccaaggaacgatgacgaaccatgataaatgggaaaatgattgtttacaacttaatttattttctccattacaaacaaatttatagctttttctattcccaattgcttaacatagccgtctcacaattagagaaagcgaaaacattaattatcccaatacaataatgaatatattcaaacgccgaagggaaattgtcaagagttgttaaggttttaaaaaccttaaacttcaatacaaccttcacagttcacacccttagaaaatggtccagttttggcccaaatatttaacaacatttgggttacgagtatttgccctttacaaatggatcaacaatctccctggatcaatatttagtggccggtttcatgaatcaacatattctttttttttttttgtctaaagaatcaacatattctaaatcaccaaaacactttggtcaacaattttcgacaatatatggaaattaggttggattatcatgcgacttttttctgattaattttatgtatttttaatttacgatgtaattcggactactaatttgtattatgataactttacattttccatactactcaagtccaagtaaaatactattgtatatatatctttggattttacataaattaatggggaggcctaataaaatatactcggagtatatcatttgactttgaaatttatcgagtcaaatcaatgattgtatttttggtaaaaacaattattatgaagactttgaaagtttttaatgattttaatttcaaaaattagtaaatgctggtctggttatccatccattggaagagaaaataagaccttttcaaagctagttgataaaaaaagttctcggtcctatccctcatcttataaagaaattattaatacgtttagggattcaattcacagaagatttaaaaacaaatggaaaataggatattaccataataattatggttcaacaacaatttcgatttctaatttgaataatggaaatttagatcaaaaatagttccgactcatagataaattgaaatgtgccaaatgtcacgtaaaccagcaagaggacaaagtcaacaccacaagagacgacgacgagcacagtgtgaggttatgatatataccctctgcgagactgcgactgctattactgatttgatcccaagttttttttttttttttgaaatttattttttctttatacacaattacatagtggtaagagattctagatggcttcttaatgtttgagatttatatctagtttaagtaggaaagctatattatttgaagaaagaaaaaaacaaccaatcaaagtcatgcaatgtgtgtgagagacattataacatacatagataagatataaaaattaaagcaaacaaaagtcatattttacttcttttataaaaaaagaagttaagcaataacaaacaaacacataaccacaaagaagacaaaacatctttaaccaaaaac

SEQ ID NO: 5278 - DNA, 2000 bp, Arabidopsis thaliana
ttcatatatttcaggatcgaccatgatcagaagttttctagatgatatcgacacgaaatgtcagtctatagaaaccgttagcagtgatcagtgatcacttatatagttgctaaattgaccgttacttgtcatcgttttatgttttatcttatcacccaaactgttttttatcccacagtaaacacaattgatgacaactaaaccaaataatatacgtgtttcaaacttaaaagaagaaacagcatcgtggaagatagcccattcccagagtggctattttgtaattaatgaagttttccatgtcctcgatcaaaacaactaagcgacaaaaaggaccgcccgtactaactcgtgagatccaaacgctgctactttcacgcgcctctactacaaattcctctttgcactaacccaacatttaatttctcagattattgatgtaaatgatttaattaccagtttcaagctaataatcaacggtacataaccactttagccaaatcggtctggtttgatttatccaaattattttacacaaaccgatcttgtaagctaaccacaatgcaaatagctaaatggagagtataggacacgcgctataaagaacgtgtgtgggagtgggaatagttcatattaataccaccactaactataatgttcgcttcgtcatatctgactaattactcattaatttataaggtttttatttagtttcaattaaattataaaaaggtttgtcgtactattccactagattcctattaaaacctctgacacagaaagaagggtttcaatctcattaaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgaggtaactaaatctcactctctttatagttttactttgtttgattttgtcaattttgactctttgaattctggggttttccattaaaaaaactcagaaagttctaagatttatctctgaattgagtaagttctattgaaattggcgtatggattcgacagatttttgagcacgatgtatgttttaaatttcgatgtcgacgcaccataaattttatatatatgaaattgaaatcttgataacaacagatttggtctcatcttcttcaagttgttgttgttgatgtggctgctgcttagagtaatgtttgttgctgcaagttggcttattgtctaatccgttatattattattttattttatttatatacagttgtgtttcgatttgtaacattttagattccgtctttgaccaattaaatctttcctccaaataaaatatttattttcttgctttcatgtttttaattttgacagctactactactaagttcgttttaagcatcaattcgtttatgcaaatagagagaatatcatgtcatgtcttaaaaaacaaagttgctcagaaacaatctttttttggttttgattttcaagttagtagtaggaggaggaggagatcttttaggaatctattcctctgttttttttctttggttgagaaggacccagagaaactcttgttttgttttcagagaatctctgtttgtggtctctctttatgaaatctttatctctatcttctttcagattctgcttcttctgtctagttacttagtggccaagattcacttatttgactcggcaggcaaaatctaccgaatatcttatcttcttgcaacttgtttatagacttaaagctgtgtacttactttgttttgttgcttcttcttatcctttgtcttgttctgtctcttggtcgtgatatgaattagttctttcttcttggttaaattgcagaacaagtgaaagagcttaatatccacaagactcttgtttctttcttaa

SEQ ID NO: 5279 - DNA, 1684 bp, Arabidopsis thaliana
ctcctctaccaattttactgctccttctagcttcccttccctgcaaagctgcaacccaacaatgctaaacgtaatggcatcgacaaactgacccttcttcttcaagtcacagaacagagtaaacccagcctcagctcttccgttcctaaataacccgtcaattagaatgttgtatgtccagcaggaagctctaactccttcttgaaccatcttctcaaacaactgacaagcctcagtgacttttcttgccttgagtgtcccatctaaaagacaattatacacaatagtatcagggacaaacccgttatactgcatctcaccataaatcctcattgcatcatccatccggtaagatttacaacatccttgaatcagtatacgatatgtcgaattatcaggctcatggccagacaccttcagctcatcccatacaatcaaagcatctttagcttttccaaataaacacaacacatgaatcaggctgttatatgtgcatatatcaggaccaaaagaagacccatagaccgaacttcgctccttcatctccttgaacaaactcaatgcagcatccaagtctccccaacaaccaaatccatgaatacaaatgttataactccatgtatcaaacttgaatcttttcattccctttaacttttcaaatacccttttgaactccgacctcatatctgctctccttagaccaaccaagagctcattaacagcaacagttccaggaagataacttacaataataactctaccagtatcatcatcactatggttatcagaagcttctaaaagcttaaataatatagacagagcaagacgcaattcgtgtttcttcaccagagcaataagaacagaatcatatacactaggatttaagcaatctcctaattcctccatgtaatccaaaactcctaacgctgattcgaacttacccgaacggattagagaatctagaagtatcttcgccatcgtctggtccaagttaactccatcttccttcattgaaccaagcaaatcgggaacttctccgagaagccctgtccgacaaacagtgcgaaatatctgagagtaagctgtcgctgaatgtttgtatccaggacgaagagaataacaccatcggaagaaatctagcttcttcgatggatctatggagtttctacgaaggatctggagaaccacaggttccgaaatcggtatcgaattcgcgtcgaggcttcgtgtaccggactgagacaaggtcttggacaaagacgcgacgagaaggacattgcagagctgtggaaacggtgaattcttcgccggtgatagaccggaaattgcagctgatacggcgcttcctcttccatggcgcatcgcatagtgaccactgagaaacgaaattgatagctaacatacacggcgtcgtttaatatcgttataatgaaacgccatagtataatgtttcttcaaggcccagaattaagcccgttaatagactgatacggcgacggtttaacgaatattataaagatagataggcctatgcttaaagatgggcccaagcataggcccatttgtataggtttttcaattttgagtcgataaaccctaagttagtctccgtcgtcttcattctcagctttgccgttttcatcgattaaagagagagaggcttcgttcgccgtccgtcgtaaaa

SEQ ID NO: 5280 - DNA, 2000 bp, Arabidopsis thaliana
tttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacata

SEQ ID NO: 5281 - DNA, 2000 bp, Arabidopsis thaliana
cagaaagttctgatctaagtgattctaactccgctgctgatagctcgacctgccaatgagagagtgatcaggattcaggagaaaaccctgaaacttcaatgaggtgaatcaaaaacaaagaagaaaggtgtgagagaatggaaccttctcttgaccatctgaaacccaaggcagacggcgaagagtgaacaaattcaacatagttgctgctcttttcaggtttctgcgagtccgtgactggctataaggcctactctaaacaaaaccacccgaaaaaacaattcatttcagctcagaatttcccttcttagcatatttattcgctaacaatttacctcagagaactatcgtcctttggctgcgaagatgatggagtatcgtgctgagaagattctgctgtgggactaggagcactaaagtgatcaggtaatatgtttagcttcttaggagtaccatcatccatgaattgaaacgactccagaaccttccactagaaaatgaatcaaagcttagccagagatgaaactactctaaaactctcagcttgtagtacattgattccccaaaagaagtcgaaaaaatcacatagttaaaaacttttttgtccattcaagagatgtcatctgagcatgatctaatctagattctgatatgagacaaactcctatatgaactttagcattccatgaacattatttaatctccctaaatgacttgtctctcagtctctatcttatgcttattcttatcatagatctaatccacaagtatgtatgtatcatcacttggagagatatataactactaaaaatccttattcctcactgaggatcaaacatacctctttatatatctttcaacgccgaattttacaatcccacttcaccagaaattttgatatcccttgtgagaaatcagctcgctgtaaaagaaaaacaaagttcagcttctacaaaaagaaagaggacgaaaatgaactctttctttttcccattctagattttattagctcaaattaaaaacaacagaatcgaattttctggaaaccctaacaaaatacaaaaacattgagcagaaatagaagctcggaagtcggaatcgaatgacgggaacctcgaataatttgaaaaaattgactgaagagaagatcgagaccttgtttttacctgatcgaatgtgatctctgtattcaagggaaagtgtttacgcaattggttttttggttgagtgcttactgcttcagcaggaagaagatgttgggtttgggaattttactcataaagaaactttaaatttggtaccaaaaagacgcttttatcccccggttaggttgcgtcagccagctctacccacatgggcattgctgcagatattacaagttttgtaatttgttaacgaatgtttgtaaacttttgactaatcttatctacaatataatgaatttatcgaatcaatgtaaaagttgttttcattcatgcttaatacattaattgatcaaagttgccaactaagtatttggtgatgccgatgagtgtaaaggacagcctaagacaaaagtgtatgtctaattatgatttgggagtatgggattccaattattaatgtcgttgacccaaatgatttatcttcttcttgctgcttttttcttaataaacaaacaaatccacattattagcatttagcaatatgtttaattacattaccattgtttttaatctaggcccatatctcttaagaatattcaaacttggtccaggttaaacttatgacaaagcccaaatgttcctactctttctcctaaatcattattccaaacaccggttacgcattaaccggttcaggtccactggtaatttggaaatagatagaactcatctaactgaaatcatgatatgtggtcattataacaagcgaatcaatcacacgcttcttccttcctcttccatcttcttcatatctcccttagtcacctctactctactctgcaggcaaaaatagtt

SEQ ID NO: 5282 - DNA, 2000 bp, Arabidopsis thaliana
tacattattctagatttgccgcacggcacatcacatggaaggatgatgaaaatagaaatatatcccaacttggggaatgttttgaccaatgggcaaccttatcttgttcatcaaatcataatacaatcttttctctctcttattgctgttggttaaacaataatcaaataaattacccaacatggcaacttaagtgaatacccatagattcgctatttctgcggccgacgtatgagcaaacccgtgaattaaaaaaacaacttgtacatcgaaatactattttaaacaacatttcactaaccttggccaatatattaaaactacgttaactttttgtatatttataataattgtaatgctgttgaacattgagaagcaagaaaagtagaaaactgcgaaattgagtgagaaatgaaaagaataataataatggtgatggtaactaattatagaagagcatataatttgtgacccatgttgtctatgagcgaaataatttttgattttataactattaaatttaacatgaaaaaggtgtatagtatcaaatctaaatctaaatgagtatatgtgattttgggggaaatcacacaccattgtcatttgtatattattatatggtagaccaatgttatatatatttttaatcgatcgaggtagaccaatgttatgtaaagtagaaacaagactgaaaaaggcgtagagagcaataaggtcgtaatcaatttgtaaaacagactagaaaattccaacggaaatccaatttacattcctcttcacgacaaaacacttattaggttctgatgtgtaaaaatggtcttaaagccatatttttgaaaatgactcaaacgaaaggaaatgaaagaaaaatatatatttttattactaaaaagcaagagaaaacaagtgctagagctagcctagagatcgatccatcaaagcaaagcaaaatgaggaaggccatctaagattagcatctaagcaagaacaatataatgatattcgtccgtgtgtgtttattaagttatgcatgaatttctcagtttgactcgtgcatatataccccgtgtgtgtttattaagttatgcatgaatttctcagtttgactcgtgcatatataccccgtgtgtgtttattaagttatgcatgaatttctcagtttgactcgtgcatatataccccgtgtgtgtttattaagttatgcatgaatttctcagtttgactcgtgcatatataccccgtgtgtgtttattaagttatgcatgaatttctcagtttgactcgtgcatatatactatgttaattatttattgcttttgacatccatatctaaaagtaaataaatatagactctgcctacttgattataccagatcacaatcaccaaatcatgatataaaaaataaataaacagaagtttagcataatgactgaatataaatcatgattctaaataaccgactgaatcataagaaattgcgcaattccgtaatcattgttcaattcaaccggttatgtactcatcatcacaatcgtgttaaaacaaaacaaaacaaaatctgtattagaaaaaaatgggggagaaaaagacaagaataatgtatgggatgctcgagagtaatttgagggaaatcacaagtgggctgaagaacttgttgagtttcttttgacatatcaatagactaagaagtcacaagtgggctcaagaacttgtcgaattactttcttttggcatatcaatagactgagaggtcacaagtgggttcaagaactaggaacttgtagaaaacttgaagaaataaaataaaaagggagggaccaaatggtaaaaataaaacataagaaaatatttgctataaatagagaagaggagctctaaaaccccaaacacttttattaaagaacttgtccactgtcttcttctgcccattttaccattttgattaggctctctgtttctctttcttggttctaaaagatatccgtcactctttagtatt

SEQ ID NO: 5283 - DNA, 1370 bp, Arabidopsis thaliana
tatcactctctctatctcactcactatctctgtgattgcaaagtctagaagaaacaacagatgcaggctgcagcgaagacgaagaagaagaagaaatgatcgaatgagagaggtctatcggtttctacagtggatccgagagagcccatagaaataattcaacaacatatctccttaaaacttctggcccaactaaaaggtcttgaaaggccgatttgagtatcttaatgtaataatcaaatccggtttattatagtgacatgaacatctttaatgtaaaaatcaacttcattagtacaaagtgtgtctttgttaggtgatcaaatcatttatatatacatgacacatcagaagataacgcatagatttttatttgcggcggacccatttattgattaatttgtatatctatttgttttgttttcggtgtataataaatgccggtataactaaaaaaccatttcataaatgttgttcagattgagaaaccaaaaaaaatggaggtgatgaagaagactggtaccaaaaaaagatggagtaattttttcatgtgccattaatgaatgtatccgaagttaggcaccttcccttaaatatccccataaccaaaatataatgttacaaaaaagtctctccctttccccaactgtacccatcaatgcctatgtccattcctctcccttgcacataagctttgctctgtctatttaatttaactcttcttctgcatgaaagttttatgctttcgatgattcccaaaatctttctcatgcgttttttactttcttgatttggcaatcctcatgagctgattttgatttcttctttatggttgccgacacgaaaggtttgttgttcttgacttgtgtttttattttattggacagtcttcttttggtagatgaacaactcaaagacggagctaacaaagttgtttttttgatattccattaattttcctttattttattccttaatctttctttgatttttctctgcattgtgtcatgttttgtggcattactatttaaaggaattttttggtatctatgcattaatgtctgatttcttacatgacagaagaagctaggacacaaaacaactcaaattttgtttggtgagaaaaatcaaccaagaaaatattgattcttttggagcaaggagttggtttgattggtaatgctcaagttggtctctcttttttcttttcaaatccaacttgatttctttgttctatatgatccaaacccatgtagtataaatctgtagtggattacataaccaccagaaaaaatcatttctagtcattgttcattattgtctttggtttgtttgaactttcttgtgtgtgtggaccataagaagaagga

SEQ ID NO: 5284 - DNA, 2000 bp, Arabidopsis thaliana
tcacgaaaactaccacatggcgcaaaggccaaaaccacaaaattcagaaaagttggtatgcttccacgtaattgacatttttcacgtgatttgcttgtgactactgatgttacaattagtagacgtaccgttcaataacgtgatatttattagagattattgatttgcataattagttacaaaatcacacgtcacaaccatttttccccaatattacgtccaaaactgttgattcgtttgatttttattgtccgtccaatgactatttcgatttattataacttcttgtgttagtaaatagtaattcaagtctatatatactcttatatcataaattaggaaaagtaagtactgtatacgatcattgtatctaataaaatatgaaatatgcgagcaataacggccaaatagagcgtaacttcagttttttttgtgatacctagttttaaataccctaaacatcaagttacctcaaattggcaaaacctaattttgctgaaattgaaagaaaaataatatatttttatttctatatttgacttcatttaaatattattttcgaaataaatatttacctacgattgattttatcaaccagttgaacgaataatcttcttttttgtatgttaaggtgcacttataatatatatttctatatatatcacatgaaagaaaaataaaataatttaaataataacaactttcagaactaagtttttttcatattaattataaaaaatttgtatagtatactatagactcaataatagtaagtactaagcagtaaccatcaataacaatattttctaggactaacattttatttctcttcctacgaacgtaccacattgtatcatgatagccaatcaaaatacacagtactgaaactagtaatgataataagttaggcagcctaattatatacaacttttcaaatacgtcatatgaacaaataacattttccgtaatatgtactgaaaatttccacgataaaaaacaataaaaatgctcgattaatgttcttatacactggcattaacaattctcacagcaaaactaccacactaatcacaatcttatgctcatgtagtatttttagacaacattgtacatgtagaaagttctttaactcttaagtattatcgactagttttttttctagaatgaatttttctaatcgaatactttaaaaatagagtcgacgaaagagattaaatataacaaaaccaaaccacgtgaggatcataagctatggacgaggaaaatcgtcaaactttgagataaatttttgattgattaggtgtttgttgtactttttcttattaatatccagaattcagaaccttctcttcctcaaatctgtctttatcctttttaattcaattttaatctcaacttttctatattttatcgtctaaatttaaagaaaagaaaaaacccaaaaacagaggattttgatcaagtaaaagaaagaatattttctagagaaagcaaatcgattctctcacctttatatatataacctctccacctctgtttcgtctctcaatatatatccactggtctttcctttttccggcaaaattgtaacagaaccaaaaattactctgtttttttttattttcttgacaagtctgcatttttctcctctgttttggaattttctcgtttctggttttccgatcataaaaaacaaacaaaactaccgtaaaataggctctctccacagaaaaaaaagaagacttttctttcattcttctgcaagtaactgagcagatttcggttttttcttcttcaaattgatatttttaaagttataaaaatttcttgtccataatttccgttttccttaaattcagctgtcctaacgtcaaatctcagacactcgcttgcgtgtctccctctcttaaactctctctttctctttctcttttggtttctgggttatttcaaagaaaagaatcaagaaacccctctttctctcttacaagaatcccatc

SEQ ID NO: 5285 - DNA, 1417 bp, Arabidopsis thaliana
gttactttcatatcctataaataatgttgcactctcttgatcacccatcaaaagcttttgaaatagtttttggtaaatttgtgacataaatttgtgatatatcaccacatcgtattagtattaaacatttgtttcactcttccaaagagacaaaagcaaaactaaagaccttcaacttcaaggtcaggatatgtaatctaatggtttgtctttgtggcattttgccaccattggttcaaaataccattgctgtatgatcagcctcctcagattctatttgccagactctacggcggtatattcgcttttagaaaaaaaacaattttgtcgaaacttttttttttttgtaaatattgtagattccacacacaagactgtctaagattctttgataagacacgacaaatgcgatttaagatttttcaaagaaatgaggttcgttgattgttccactaggtttggtatatttataatttgaatttttttttttaaagatatttataagaaaacgaaggagtgtgctcgcgtcaagtgtgtactaatagtcgatgacactagtgatacgacgatactggaaagggacatcaatattcattagtaagccatcttagcaaaaacgttgttatcagataagaaaagttctcagactgacgtggctgtcaatctccacaacgtgtttatctcccatttgggtagttacggacaaagacgttgaaaagacaacaatatggtctaaaagattgacatggaaagaaaattgtttatccgacaaagacctcttggtccaacgtggctttcacatcactagtttactatttcacatctcatggaaaattactgaaattagtacttgtctgtattttgttttttcgtcaagtatttgtttgtatactttaggtaattgcgtgccgaagaaacattgctaaattgatatttataccaacttacaatagtttacagttcaaaaatagaaatctccattttgaagatacaccactaattttcttcatttatttaccccataagagaacgagaaaagaacaatagtccgttgatttcgttaaaatctagtttcagaaagacacgtctagatctgtctgatcagggcagatagacacaagtgacgaagcaaaagaaacacaaaaataagataagaactcttaccactaaaagataaaaataagaaaaaaaataaaacaaattcaacgatttgccaagataaaagcagacactgtacataagctccgcattcacttacgtgttggatacttaatttgacactcttctttgtgttttctcttccaccttctttttcggtatatcattcaacaaaattctctcttcatttctttattttgttgttttttttattattattgaaatcaagagaattaaaacagaggctctgcaaaagaag

SEQ ID NO: 5286 - DNA, 2000 bp, Arabidopsis thaliana
tgcgattttcttcttactcttctagaaacacttcctcatatttaataagaaacgaaagaattagactccgacaatattgggaatgtttagttgtcatttggacccaatataatcaattccatacatttgcaattgcaaggtgggtgagtcatcaaaatttatgaatcttccaaagattatagatagaacagcttttaattagcctaataaacaaaaggaaatacgattatgcatacaaaataaattaaatattaagacttttaatgaattcttaaccaaaaccatatcaagtcatatcatacactatcctccatacacgtggtagcatacataagtacgttaaataattttatttagcaaataattttattataatcatctttgatcaccaagatcatgttgggccatccaagccacgactttagtaatgtgaaaacaatatcataaggaacgaaacactgttcatttcatacaattaaaatacaactttttcctacacattttctcaagagtttagtaagtgagagacgaatgatttgagaaaacagtttttacttttttcgatttgtttctcaaactcagtattttcggatttctaatccagattaaaagttctgaataaaatcacggggtatggagcaaagccgatataagtaaaaacctttccatattgatagacactagatttttttttagttcataagatagatactagatttagtttgagtataatggattaatgtggaactagttgtattgtttagtatgtgtatgttgtatgatttagtgaccgtcttcagttttcttgatgtctttccacgttttacaaattcttgaaagaactgagaactcaaatgtatgatacataaccattgaaaaaaatatttccaccatcataaatagagttttacgaatcgtttcacaacttttaattcagttgacaccattaaataatcaatatttctttagttacaattcagtagaataaaattgcatatgctatattatctaattctatgaatattttctgtctatgatatttgatttttatatactttagattttggatcacccccacattatttcgcttttcagtcacattttgtgtttaatattgctagataagtccgtggttatagcttactttgttaaaatcatatatctcaacttatttcataacagtatctaaagaagatggaattttataaatatatagacactcaaaaatcagaagaaaatatatatccacaaataatagaagaaaacatagatttactgcattcaaatcaagggacatgaaagaatatcctggacccaagtgggttatattttcaataaaatttagcaaaaaaagttgacaatcaactaatcatcaccattattggccataatcattacgtacgcatacacatagccacgatgtctacctatgtttaaatctttgaattctgaaactacgtatcttttatttttgtttaaaaaaaacctagtacgtatcttctttccttacttagacatcatcttctaactttaaggatcgaaattagaagaaaaacaaatgattaatatctacaagaacagaattttgcatttatactcagatactcttctagtacctcacaaaaataaaatgaaattggaattgaacacgccctaaattcaagtactatacggtctatacccatttgagtatatgaataatgcatattgtgagtgaaagagatagatacgatacactcttttctttgtttttcaattggacaaaaggaaacagattttgatctctgaattgaacggtcaagatcgtatataattatttcaggagattaagatcccacgtgcttaaaaactctctgtcagactctttatgtataaaatcctcggcccactcttgttttgatagtacactcaatagaaagacacaaagaaagaaagaaaggacaaacagaaataacaaaaccttccatttcaagaaagcatcatctttgtgtgtccgaaaa

SEQ ID NO: 5287 - DNA, 2000 bp, Arabidopsis thaliana
acatgcatgtgaacatgtgagatttctctttgtcttctatttaattatacaacatgtaacataatttttccaaaatattatgtgaaacatagtataatctgatttcactgcgaaataaacgaagtgacttgcatatatcaccaccaaaatctttacaatattagttgtgacgaaaaagtaaacaaacattaaaagaaagtagtgtcgacatcatcattcatcatatatgtggataaaaatatctgaagagtcaggatctcgtgatcacgaactcaagaatatgatgcgtttacctcaaatctcaattaatcaaattttttttttccctaacacacaaaaactacattatgagattttttttcaaaaaacactattatgggaatttgcttaattgttttcttttggactaaatgtactagacgctgactgatcagtagaaagctgttaactaccttagccatgtggcgcttattaaactacaacagctagcagtgaaacctaataagaacaaaacgtgttcgattttggtttggcgatactttgtctcattataaaattgcatgttttataaataaagatcaaataaaatatggtgattatatatatatatatatatatatatatattgctgaaacaaatccgtgcataatatatcgcaagtcttaataaacttaaaaaaaaaaaaattgtttatagaataacaaataactaacactaggattgtttttgttttttttaccgtcatagttttatcatactttttccttttgcaaagtttcaataatattaaattgtaaatggttcaaaccaaaaaagtgtaaaaacaaagaagcaagcatgtgaatgtgaattgttgggaaaaaaaaaggagatttatatactcatgtttcaaactcccattaccttgcaccaagatgatataaaagagcactatacaagatttctatcttacaaacatgggcttccgaaatttaatgatattaggaggcagtaatatttttctatatagatctaaagatgctataagtaaagtttctctattttagaattcaccatcttatgtgttgcatgcatgatgcattgcatatagttaaatccattaacgcgtcatagacaataatagatcattggccctcaagttcttctcttcagcagtaaagttcgacttcactttcttacaagaggttagtatatggaccagtggaccaaacaaagaaaacatttgattaattaccaaaaacaaatatctcaatattcttttgtcagcatgatcaaattggaagggaccacgtggcgcttgatgggaacgctccaacgccaaataaccaaaagatatccaaaggaagccaacaaggaagtatagtggaactcgcactcaatggtttcgactcggacacacacaatatctgattttacttttcttttttttttaattgcaagtttgccactataaaatcagtccatacccttagttaacaacccacattcactctcatttccatcaaaattataacttcattttacattttgattaatatcctaaaatgggtaatttcttgtttcttgcaatggtcacttacatatgtctatctttaaaacacacacaaaattatatacgtgttactgatctgttatcatctctgttttaatcttataatttcagttagattcatcgaagaaaatattactaaaatgttggagacaaaggccatctcaaactcggaggttttatatgtcggaggagacgacggagacacgtcaccaacgacgaaagttcttcatgattttcagatcaacagcggaggaggactgataagatcatgggttgattctatgagagcttgttctcctactcgccctaaatccttcaatagccaatcttgttggattgtaatgtcttcttgcttcctctgttttgtttgttttaatcttttatttcaaaaaattattaaacgagagaattacaaattttgcagaaggaacatccatctgctttgaac

SEQ ID NO: 5288 - DNA, 2000 bp, Arabidopsis thaliana
tataagacccatgcatttcatgctaaacatgttgctttcagtgaaaaacaaacaaaacacaaaccattaaaaccgatcacgacccataaatgtcactgtcggctaatataaggtatatactaaaaaaattccactacggcatcacctcaataattgatcaataaatatatctactgttgttaaaacgtgcctttgctttgatagcttctcccgtttttaacgtgcacaatcggaaacgattttgtttcgtcgagcttaaccgacaaaatatggcaaccaagccggagagtgccaagaggaagagcatgagccaaagctcgaaccaagtcgttccttagtacacctcttacttctccataggatgctggtccaaccgattctcttcgtttaatacctttctcgatcaaaacatctcttatcctgttttagtaccataccggaaatcattataactagataaggttagttaaaatataaatatttatatacttactgatgaattgggagagacttaagacgaagctagcttatcggcgacaccaagttgttgaagagcaagccagccgttagtctgaataccaaaatgctgctccttccgatcttacagactctgatctctccaacacaacgctctttatgcccttcctttataatcatatttgtatgtttagttagtcaatagttcatgtatatgttttctaatttaaattaccttataattgagaaaatgaggagattatagtgaacctgtgaagagcaagggaagttgcaagaccagcaatgcctcctcccacgattactatgtccaattcttccattcttctatatttgtatttcctccaaattttatgatcgttatgtcctgcaatgtcgtggacttatatgtgggggttgaagccacatggcaatatggcatgtcgtggttgtaccttgacccgcgtatttttcgttatctatacatattcattcacagcgatttttattggtatttgtcgattcatatatcaattaaactgtgtatcacacagatcgttatatgaaaccaattctgaagagagaaaaaaaagaaaagaaaaatttaagccttcttgtgttagaattactaattttaataatttatttaatatttttactgtattagtgattaaatgtataatttacttaatcttagaagtatatatatatatttaaaacaattattttcttacacgttatacaatatttgtaattaattgtatttatttatattagaaatatatatacctttttctaaaataatatatttttgttttgtcaattgcccttataatattagtaattcattgtatgatttccttataatatttttacacatgaaaaaatctctaactaaacatcttttcaataaactacatgaactatcaaatttgttataactttcagttatcctccaaagtccaaatattcaaagtgaattattcatgggttggatttaacaaaaataataatttcgaggttgaaatgacaatagatatttttaaaacaaaggaccaaagtcgaaataacaaaactcatcggccgcattaggtttggtcctaaatccctaaaaccctaaaaaaacacaatccctcttagaaacagagagcttctcttctttctccattattcatcactttcttccccgaagatgcgtcctttagacgagaccgagacaaccgtcgtcttcgagaagctcttcaaattcgtcggcaacaacctcaagaagatcgtcgagaacccatcagacgaaggacccgaatctacacccggcagctactgcttccgcctccagaaaaacagagtctactacgtcagcgaagccctcgtgaagcgagccacaaacatctcaggaaaaacctagtctcttcggaacctgcatcgggaaatacactcacgccggtagtttccatctgacgattatgtcactcaatatcttggcggcgaatgctaaacacaaggtatggcttaaacccacttcggag

SEQ ID NO: 5289 - DNA, 1691 bp, Arabidopsis thaliana
ccttttcttgtccaataagctataaccttgttactttgtactaaaacttgtttttgaaagagctacgaatgaattttgctgagatttgatttttattattattgaatcaatctttgtttttattgtaatatcttagaacaacacaccaaaggaacactttatcaattaaaaaaacatcgcaaagaaaatctgaagtttgggtaagtaactatagataggcaaaacatagcagaaaaaaagaaacatatatcgtatttattcatcctagcacgtcgtattccacggatgacctatttatagatacacagattgtaactaggatcttcggaagtgagcatggcactatttgggaaaaagaaaaagcatgaattgttggttcggccatgttgtgcgtaataagaattcatcaagtatgaagcatggcttattgtagtattgggcttaaaacatgctccacttggtaggattggtctacaatcaactccattagcgcacgcaaacccgagattatcttctagctgctcatacgtcgctgtcggcattgatacacaccattgttttgagtttgctacgggaaggtggttgatcattatggatgataggaggattccgatgaacatcaaaaacggcgacatgtttgccatctttaaaaaaagtgaacaattctatgagatttttagtataatgacgtgatgatggtttgttactaagagaggtgattatacgtactttatagaagagtaatgtacgaaggaaaggaaagatgaatgtgtgaaataacattttgtacataataaatgaggaaaatttacaaaaatagtaatgttcctacgaagaaaagtaaagatgaaaaaataaggaaatgattaaataaatagtaatgtctacaaagaaaaggaaatatgaatatatgaggtgatacatttatacataaatgaggaagatgtttaggagatgtcagtctaccaaatcttctctttacatatacgaatactctaatatattcgaatgatattcaaagaattttattttatatttatgtgagtatgttgtaaattatgaatgttcttttttttttttggggtcaaatatatcttccctttacttatatgaatgaagactctaataaattcaaagagttatatatgttagatatatacaagagaattttaaattgtaaatattccttttttctggtcatataaaatttcccttgacatatatgactatatgagatcaaacaaatggttggttcaatctcagttaatattaatgcattgtttaccttccttgttttggagatgaagaaaatttcagagctcctaaagtgtagttggctacaactacaaagttcctatggtcactcccaacacaagaggggattgatgatcttatcttataccttaagttattctcaacagctcaacatcatagatgactgtgttgtgtttaattccttaccttctataataatacaattatattggtactataatcaccacttgcttagttatcacaagctagtggtatttaaatataattacttgctcaatgtctctccaccacgttggcacgtataccctcgaccatttcttatgcttatttttttttattttgttgagataagacaaaacctttagcttcgtcttcttttgactactaagttgatctagaaaaaaatcgccggaaga

SEQ ID NO: 5290 - DNA, 868 bp, Arabidopsis thaliana
gttggtttcttctcttgcaacagatgggttccatgcttctatgtgtgtcttttgtatattttacatatttgatttctaagatttttaatgactaaactcattcagtaatctgatacaaaaccatgaacatgaaaattatcgattgacaataaaagttttatctaaaactcttcaaataacaatatatatgcaattaaaagttttcttatatgaaaacaaaattaaatggacttgcatatttatttacaacttttttacatattatatgaaaggatcgagatactatataatataataaggaatccaaaattgaatatttgggccgtaattaccgcattaatgggcagacaaaacataacaactaatgggccggaatcaatgttaggttatgggcctcaaattagaaatttatgttaacgtttcataaaccctaagagatttcttagaagtagtcatcttcttctctttagacctttttttctgcaggggggctctaaagcaaaacccttttcctgaaatcgccgtcgcaaattagaagaatcacctacaggtttgccgcttaatctcaaagtcctaatcccatctcgttcgtttggtgttctctttgttatgattttttcatatttgttgaaatctagactaatttttgagtagtataattgaatatctgttcattgaaaccgtgtaattagagaaaaattgaaactttgtcttctgcttcttagctcttactataagtaagcgactttatttctgggaaagtatcctctttttttgtttgtttgttgtcaattttgtggtctgagtttcagttttacatgtcttaactttgcaacagtcttttgtagggttttcaagacgaggcaat

SEQ ID NO: 5291 - DNA, 981 bp, Arabidopsis thaliana
tttcaataacaagagcctgcattgacaatcaatcatttcacttcttaaccaatttaaaatagatcaaatcttctaatgcaaatgctgatttataagatttagataagattgacacaagaattagaaagcagaacaatgaaggacattccatataatcttaacaacagaaatttcatgtaaaggagatgactttcgaccgagttataacaatgaggcaaaacccgaaacaaagggaaatcgaactcaagcattaaacatagtgcatgcatcattattacaaaaagctgggcagatttgaaatcaagacaacaacacatgaacagcaatgtatgagtataagagattcaaaatcaaatatcagggatttagttttttttatcaatagcttacctttggataaatcgaaggcggagacgaacgagaaatatctgattgacgatttccaaaaacaatcgagctcggagaaagttttctcccttctcttttttctagttctggggaaatggacggtggatctttaatctctaccaaggacccaatcataatttaacacgtgtactgatcgtgcttcgttgtgcgcggtttctatggttaatctcatcgtgcctagatgatcgacttttagtactgcgttttctcaactgttgggcttattcataaagcccaatttaaagtttaggcccattaatgtcgattgtatcttcttacgtaaaaattgtacattgtaatgttcaaaaaccgaagtgttttgtgattgttctagacttctgtagttctaaaagaaatgaaacaaagatgaatcacaaaatcagcaccagatcaaaaacgattatgggccacaatttttgtgatataaacattaaaatgacaaccacaagaaaatatcaaccaatcaaagaaagccacgaaacagagtattttaaaaacagaggaaagcgaaagagataagccttttagacaaaactagtggcagactgaaaa

SEQ ID NO: 5292 - DNA, 2000 bp, Arabidopsis thaliana
tatgatttacaacaacagtcaaacctagtaatatgttctgctaacattagtatttgataatctcttatcctccatacgtgataatatcttcctacttaaccacaaagaaaatcagataactatgatatgcgataataaacaacgactcatatataagtaaacattcaaatacaaagatattaacgaaagagtttggagataatcatagttaaacacaataaaaaataagaggatacataattcgattagagaacataaacataaatgtaaaaatatttgagtaacacatcagttagctagtaaccgccaataaggattaaagccgagactaacttcttcacttcactttgaaggccgccaatattgaaatccacacattcagatacacccctggtagcatgagtatggataagaaatatagagaagatacctgtgtcaattacccaaaaatttgattacctaaaaagtcttatggagcaaaacccagatctaagagagaggttatcacttgaaaaccgaaccagataacacaagaattttagggggtcgagagttatttccttccgcctcaaaacgccgtctctcatcttcatatatgaacgaaagaagacgactgttcgttaactggaaagaagaaaatattaataaaaaaaaaacacaactcccgaaaacaatatcgcaataaaatctactcctacaacatgcaataatatagcctacactctacaactagtaaatctataacataggggtacatgcgtaaaaataaagttaacagtgttggggcaacagtacattttgatgagactaattatccagtcttctgagcatatacagtgatattatccttcaaaaaatttgatgcaaagtggcaaaatcaacaataatccctatatagaacctccatcacaaattattatcaatctaagctttgacaattttttggtacttcaaaataggagagtaagttattattttgttggatattttctactttgaaaccaaagaatgtgtcaaaactcaaaagtaagtgcatcattcaaatttcaaataaagaaaaaagatggagagggagaaaagtgcatgaattgttttatttataggattgtaaaaggagatcgttgcaccttttgccaactttgcattcattttaatggcactctctccactcttgcccatcattgcaactcgttgtttacagttcattgttacatacaatttatttttattttctgacaatacactttttgatttaaagtcacttatgttacaaaactatgttagatatgaaaaatttgttaataaactagccaatagacataatcaaaaaaacaaaaaaaaactagccacaatctctcttttacttatggtttgccatttttgtatcttcttataccaaactctacactacaatatagacctacacactacaaaaatgtgaaaatgaacctaaatatactaaatatgaacctatactacaaaaaaattaatttatcacatgcaatcaaaataacgtaaataatactaactagataagaatccgcactatgtgcgggataaaacgactgaaataaattattatgtaaaattattgggatctaatatttgtttgtatacaacaaaatatgtaattaatgtttttattttattttaatttacgtttattttgtatattcttatgatgttatcttaccatttaacacattaatattagatgttagtttaacatttcagttttcccttgacaaaaatttgaaatttcagtttattctcaaatataaataattttgttcatagaaatattctaccaatctggaagaacgaccgattttagacaaatataatttattccataaagcattttacacactgagaaagtaatgattcatgtcttctctttcggcgaaaaatataaaaaaataaacaataataatatatgaaaaaggcaattccatttatttagcatgctagagagcaccaaaagagactcatcattcaca

SEQ ID NO: 5293 - DNA, 1098 bp, Arabidopsis thaliana
acaaaacgatctcaagaccgccgtggtgattttgaggtgtttggccggaagttaaaaagagagaccgttgtgattttgtcatgtaaattagaagaggagatagaagaatcatacaatttagaagcaaaagcaagtttaagctttacaataagagtgatcagccgatcacctatagctataatagtcactctcttttcataatgatcaataaataaagctatctatcttcttctgttttggcaatttctcaattaggggtttaatttaacattttctaaataattggggttaaactgaatttattactcctctcagtggttttgcgtaaatattaaggggttaaattgataatggaaaaaggttggggtcagataaaagatcgaatagcttttataagtgacgtaaatatataaaaacaaaacgcggaaacaattaaaaataaaatcaaaaataaatcgccgatcaatccatcttcttcttcatttggtattgctgcttacgtcgtcagatctgctcgttttttcgctccatttttgggtcaccattactcagcttccgtaagtgttttgattgtttgttttctccgaagttttgaatcaatgatctgagaaaatttccctgtttagatcgacgattctcaaggtttttgttatgtgcttgttggaatcgttttcgccgattgagtttctagatctgaagttcaatcggtgattacgattgagatagttgctgttgttactaaggttttgattctctggtcagatacattagactgataaacattttatggcgttttctacaaatttgtttgtttcctaggttagttttcttctccactcttaagtagtttcggttgtgttcagaggcgattccgtacatgattttctgggaaaatacatctgtgttcatctcccagtgaaaatacttggataaaatcttctagtgtccaattactattatatgggaagagattatgtgtaatcttgtatgttaggaacaaaacctggggttgttaattgtgtagataaggtgcagagatatgtgaatttgaccaaccaactgttttgttgatcctttaggttttaaatatcacattag

SEQ ID NO: 5294 - DNA, 2000 bp, Arabidopsis thaliana
ttagatagttaatgctttgaaatcttagttagttatacaaaggtaaggtaaacggtccaaaaatgattgttctcaatcaagttttaaataagaaggagaaaaagtcaacaaggaaatgcaccaatcaataaagtgtcaccaaatatatgaggaattccgatgattagctagcgttttgaaaatacttcggctactagctatgtttttgagaagtacgtacatgtggttggtaaaagaatactggaacattgtcactagaacgttcgtgattgtacgcagtattcatgccagttgatgttgtgcaccatcaatgttcattatgtgaaccacccaaaaaggcaaaaacaatggatcatccacctaacaatccaccccaatctaggtagttctaaaatcacacgacttacatcaaaggaaaagtttcacatgtttatcaatcacaggtcacagtatgtttgaaagagatgatagaaaaaagatatcaaatttgtcccgtgttgataggaaagttggtttggtatcgtattataattttctctacacacacacgactcatgtttcatgtgttaaaaaaaaaaagcaatcgttttaatcccttccaatttatataaatctgcgggctctgtttttatataaagaaaattggatcagttgtatgaacttcgaactgtgcaaaaaacttcaaaatggttcaactattttgtcaaggcttgtaaaataaataaaaattagcacactgttaaaatttgtagtattatatttaaaaaaaaaaaagatcaaattaaacaaaagaaaaacgaaattatcacgtcttttatttattattattttaaataaataatatgacattttaaattttgtttggaaattaatcactttctggcagtacctctcagccgaattgtaaacctaaaccgcccaaaagggacagattgcatcgtggtggtaggacattcataaattattatttttccttaagtggagggccgtcacacaatactttttgcccaatagataattggcccacaaaataaaatgctaaaataaatatataatctttctgtatgattgtgaaaaaatgtgagattgtctcgaatgttaaaatttggtgccacaaacaatataaatatataatcacagaaaaattggtgccacaaacaagataacatcttataattttctcgtatacttggagagcgagttgaaagaattgcgattagaataaagcgtagtgatttggcattgaatatcatttatgctacataattctacttagcgataatataaaaaaatatcataacttatggttagcatgtaatgtcactatacgaatatcaaattcataaaactagccgtgacttatctacacagaattatttatgtttcgagaataaagacccaagagaaaacaacgacattataacaaaaaaacaacgacagattataagtaaggaagaaacaaatgactatagattagatatgaaatatttttagtaaccatctttagttataatttttgttttggagcttgctccgtatactcagttgagtatttttaccacacatatatcaagactaaattctaccactaatcaagtaaaaacctcttagcaaaatagttggagaaaaacaagaataaaatcgtattattttcctctagaactatcgatcattcgagagagagaatatgaaaaagggacaaaagctctatacatgtacaaacatgacaagtcattatccgccacgtagattggtcggttccgcttcgctggaattatagcgatgtacttgtttagcctgttttcaaaattatttaaatctctaaccgctccaatcaaataatttctccaccaaatattaataatatatcatccggtaaccggtcaccaaaatggcgccacctcagatataagtaagagcacatagtagaccagaaaaaatcatcaaatccatctcccactcttctagcatcttgaagcttaaatctcagccgtccgatc

SEQ ID NO: 5295 - DNA, 1566 bp, Arabidopsis thaliana
aaaatgtaacatcgatcttttgttgatatgtttttggtgtgagagctttgttgtgttgtgtttacatggagaggttttaagaatgaagcctcgttgttgttgttaacaatgttttgccataaacatacgttaaagctttggggatgttttctttctaactctcaccaataaataaaataaagacctctttttaaataacttgttatgattcgatatttgaatgaaaaccaccttatttgaaaacaacacaagtgcttcgaattattccagagttttctatataaccaaaggttcaatgtattttgtttgggcaaaaggtttcaatggttaagacttcatattccatattcctacttatgtattggctttaaaagctttttgcattttattcaaacatctgcgaccatttattcattgctataaatataatcaacaattacgtgtgacttcagcaaatatgcaccatgactcattttatcgagttatttccgaccatttattcttctattattgtatacaaatcaccgacctaggaaaaacataacataatcttttccttttttttgtaatattggtgtactaaaccaaaacaagtaatataagcgtctacacaaaccgtacattataatgtcgtagtgagttgctgaaagaaaaagagaatctcttaaaaatgatctcagatttcaacttggcaaaaaaaattgacttcaaaaactttgttcatgacttttccattttcttcattttcacctacaaacccaccatatgagcacataaatcccataaagtatactcaaatctcattcaaattatatgaggtaagaacacacattcttgatcatgatatcgtacaattctaataaacataaactaaataagtgaaagctaagaaggcacttacaaattcaaaagtgaccaaaaacctaccactttttatgaccggttttatgctacattggctcacaaaacatgtgagcttattcctcgagctaaggcactggcttttgacctcgatgaataggtggtgaatacgtctgtgacccactggattatcttatttcgacaatatgattgtttatctaatttttcgaatttttcttagagaaaattataagtatttaagaatttagtgggtcgctgccatcagagatagtggtaacatcttatgataagaaaacctaataatcctgtttaattataatgtactagttaggtaaagcaggcaatagataaaagattaattcgtaaagtaatcaattggaatgactttgtgtgtgtgtatttttttcaagcttaaacaagacatgttgagacgtactgtataagttattgaacttaccaaaagttactaaaaaggttatatccttattttgagattccattactacttttggttttaggtatcatttttgtccaacactaactaactccccctaaatcacgtgttttgtactaattaatctccattatctataatttctctacttatatatactaactctatcctaaggttaggaaaccatagagccaaacaagccaatacctctttttcatcgataaaccaag

SEQ ID NO: 5296 - DNA, 930 bp, Arabidopsis thaliana
tctgatttgaattaacaaatatcaaatatatatattaagtttgtttgatgtcgaaatttatattttgcttagtttgtaaaaatcacatgtataatttgatgtgatgctctatctttcttcttcttatgtaattgttagttgtaaccttatatattaactatttcatacaaaagttattttttataatttgagagtaatgtatttactatttaccatgttcacttcaccaaataaaacaaagcttcactatctcagaaaaaatgtaagtttatattgaaaattaaaagtacaaaatgaaacatgatatatatatatatattttctttttgaatctaaacatgaaatattttatacaataaaaagatagtgtgatagctagttttacagcgatagatgaatggaattctgataacattcgattaattaatctttagctaaattacttaatcatacaacatgttgagtgacttgattcttgagttgattttgacagtatataacaaacgattacgatcatttgcaccacaaatattaacagtattaaaatatttaatccatttagaataacttgagaaacagttaaatcctttttgggaatcagaccacacacgatttgacacgtggcattgtgggcatccaactggaagcaacacattaagttccgaaaccagaacaatactttgtttggcaaccaagtaagtgtcgaaagtccaaggtcaaatatagacaattatccactcacacgatgacacctcatcttatgtcgtatatttaacactaaatacacttatctatagcaaatggtaatatttagtgtttttttagtcaaaagcaataagggagaatctcaaagtttttcaagatcgcgatgtgtataaagacatcgcttagacgtagtgatatgatatctaaaacaatcactaatcctaa

SEQ ID NO: 5297 - DNA, 2000 bp, Arabidopsis thaliana
tactaaatgtctcaaaccatcacagtttataacatgaaattctattatgacactctgaatttgaaatatattttctatgccacctaaataactctttgttgaatataatttttattttcttaataggatatgcaaaaattaatattttatcactttgtaagatctaatcaagagtaattaagagttaatcagcagttaacttatgaattaaatcaagtgttaacatgcatttcaaaagattaaaatcacaaaagagaaaaatgttttcttaaaaaaaaataaaaaaatcttatcgtcttttattgtcccaaagaagataacgaactctgtacaaaagcttctaaccgtcgtttaaattttccataactttgtaaggaacaaatgaggtaaaattttagtttacttaaaatttagttatgttacacgacatcagaataaacttacagagacaaacaaaacgtgtaaggccttgaaccaagataactacgtctagttccaaaaccgcttttggctttattcaatttccttgtttatcatagtatcgtagcatctttgttattcagtttgaatgataatagtattgtggttaagagtatagtaaaacatctacaacaatactccgtaattagtattttgatagattaatatattttggtcttaaattactatttttgaatcaattagtaactttataaattaatcaaatcttatatattttcgacattactaacatagtatattgtttttattgttatatatgtcatcaatcacaaaaagaagaactatttgtattgaaggccaccacttatctcttattgtgtttatatctcaactagttattatgttaaaggtaaaactcttatcatatagagcccaaactgttctaataacaacaattaaagataaatctaaattttgataatttgactaacatctatgttgtatctcatatgcaaaaatatatgtttgtgatttcactatgcaaaattaacatctatgttaaaactttctatatgaaaatattatagttttttaataatacttacacatccaacattcaaacaatgtgatttcactccatagcgttttttgttattttgagatgttaattttgtaatgcaacctaaacatcttcatcttctcaaaaaatcttggtatactttaaatatgttgtttctgcttactttttttttggtttataaacatttgattattcttgtttcagttgatgaaatctctaacttgtttttctttttgatcatgttatagagttgtagttccacttgagaatatgtctgctatgcaaattacatatcatctttttcaatggcttacatataattgttgtaaaattcatgaataatatcacttgattatttaatgttatagaagatggattaaaatgtttaaaacttttcaagattttttttgaaatttcaataatatgaccaaattgtttttttttttgaatttgtttggaatattccataacaaccggaccttggaaaataaatacatgcatgtttgtttgtgtatgatgaatacatagacatgtttgtggttgtggctatcatgagtcccttcgttaataaacaatgatgtaggaccaatagctattcaataaccaacaaaacgatcacacaccaagaaactcttcttcactctctctaattctcattctcatttctcaccatacaatttttcatctccctctctttatccttttctagattttctttttacccttcaatcacttatctctatctatctacctttcatgctctttcaccactccttccataaaaatctatcaataatcacttcctctctctctctctctctcttatacaacactcaagaagcgagacacagaggagagagttagtcttcttctctgtttttgtctctttggctatatatattcaaacattgtgtgaacagaacacaaatcaacacaacacacacaactttgtgttctttaagttttgtttcagagatca

SEQ ID NO: 5298 - DNA, 2000 bp, Arabidopsis thaliana
ttattcacatttacttgtcaaaatattcgtactatagttttgttaatatgcgattaaatctaataattatgacaaatttgacttttcttatgtaaaggttgaaatacagttggatttcggttgcgctcactgaaacacgacatttttttttaatttaatttcaaagattatagtaaatttcataactaatgtatattttgcttgcatgcacgtattttagtgccaaatttaattcattttgcttctgtctattttttagatgaatttcaattacagaggtttgctatagaattgaaacaaaaatcctatttttataaatggaaatcattaaaaaaattatacagagagcgacacgatatttataatgttcaagatgcaccgactgttttatcaaagaaaaaaagatgcacacacttaaacaaatggattgagtttggcccccggagttatacatttttgacagctctaaatgtgattgggtaagaatacgtgacttcttagttcatagttctaagagaaacaacttaacaagttagaatgcttcaaattatgggaacaaagatatagcttagtgggtaccaccaccgctcattattcgattgaagaacaaatgatggagaggaatttgctctgccaaaacattgttgtttgcagagaaaacttcagttgctaaatttctggtttagtacctttgtactttctccaaagaaatacattactacatttaacatctttgtgtaaggatttcttatgaaaaagggataattgaggatatatagcaagagttgccagaagatctaacatgttggaataagtctgcttaagggatctatacggatgctctctttcagtcaagtttattacagtatatggatattttattctctccggagacataaataacttcgaattagtaaccactaacaaaatatttttggatggcgaataaattatcgtagatgacgggccttaaagggccatccaaatatgtgattttatgggccatccaactgtatatgtttatgatgttggtttgtatgaaatctataaacataaaagacaatgtggatggcagatcaaaaagataagggaaatgtattgggccatgggaaaaggttgttagttgggtctagtttaagactattgtcggaaactcggaatacactcaattaacctagcttcacaaaaataaatgaaacacgtatacaaaagtaacctatatgtgttatcggtattcaaagaatttatatgttgttgataatgcgtcataaatgtgatgaaaagacatagcagacagatataacaatttgctaaaatcactaccaagcttctcagaaaatacaaatacactcaaacgtgacatcaaatacgtggccacgcacaagtggtgtctccaagtcattagattcattttatgatgctgacatacgtgactcagtttgccgggaatgtttaactaatcaaatatggccacgtagacatcaatcttttttaagcgacatgtgtattatcttgttttcgtggtagggtctgaacttgccgacactcgctcttaatattttagtttctcccctaaaaaaattgtctcgtttgttttgctctttagaaattaccgatttacgctgaaaaaatgtgaaaaatacaatcgatcgcattatctttatccctagctaatcattcatgtacaagcatgtctccgaaggttaaaagcagtcgctatttaccggaccaacgtagttttctcgaagtggtggtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagatt

SEQ ID NO: 5299 - DNA, 2000 bp, Arabidopsis thaliana
ttaaagaataaattagtatgattttcaacatttaaatataaataccacttgaagtgtttttgtggtccattggctaccatcaacttgaggtatattaagtccctatatataataactaactaacataagttttggatttaaattactaaaagggtaaagaaaatataatctttactattaatagaaaataaataaatatttttatacaatgaggatattatataagtctaaatcctgagttaaaacctcaaatcctatgtttttttgttgtcattgcttggacataacatattgtttcgaccaaaaacaaaaaagaacataaaatgttcttaagattcaagttctttttcatatcaattaagaaataacttacggcatctttaatttatgtttgttttgatcaatcacataattatagtgaatagtatatttttagtgctattacctatccttacaaatccataatcgaatttcaaagcaacgcgacctaccctcaggtctcaaaacgcacgttcaccaatacaaagtggcattttcgtaaataacattaagaaaaaaacaaattaaaacagttttgtaataagatcaataattatatattattagatgactcggataagccattcggctttggtctttttgttattgccaacaattaagctcaggcttacgaaagtgattgtctgattgacgttttctttttcatttccttttttggtccctgaatacaccttttgagtttgaggtatatctgtcctctttcgaatctttttcttagtgattcctgattattaagaccatctccatcaatggtttctcattaaaaaactgttcaatataaaaataaaatataatcaaaaagtatgagagagagtagaattagtctttcaagtgagaaactctgagaaacccataaaaacacttgtatatcatctatttgtcaaatattattttattgttaaaatttaattatataactaatatttattaaaatacttatatcttttattttttagaaactaagaaagtatctcactgatggagatgcccttaatacaattcggtttgtatttatttctatttttcccgtaattttatgaccctgtaaaaaagttaccgtgtttttttttcacttttcttacatgacataattaattacaaagtatccatcaccacacaaatcaatacaaagctttttgaagtgtgatggtgtgtttatttaaagactttgaagtttggacccagaccattatcacacaagtggaccttattttatatttcgggtccagttgttagaaatttctttttacactgaattcattaattaaaaaaacaattatttaattagtacattttgatcgttcgttttcatgctacatttgagttttaaatagagaaggtctcaaactcacaactatttttttgactttaaatgtataaattagctgcaactttaacaaattgtgagtagttgtagttgcctagattctatttgaagactacagaccttaaaaaaaaaaaaaaaaagaggtcatagtcaaaaacaaaaaaacaccacatttggtaaatttatgatgtgttctctttttaaaaataaaataaatttcatgtaaaaaatctgtacgttcaaaatatctcaggtgattaatctgtaagtacaaattttaattttcaacatgaaattgaatgtttaacaataatgagtagttggaacttggattgaaaactcaacaacaactcattgtttggataagtaagtagaaatctggcaataaacgtattctatttttgtaacgtagaaaattagaaaaataatagtaagaggaaaaggcatggtttagtctggtcaagttaatgtaaaccagagtggttaaaaacaaaacgacaaagcaatttggcttcttaaaaacccgcccatggagaaagccctcacgcacctctaaaccacaaacaaaaagagagagaagagaacgagagaatcattgagaaacgaaacaaca

SEQ ID NO: 5300 - DNA, 579 bp, Arabidopsis thaliana
ctttgcatctgtggttgggatcttcatacttcttccagtgaattatatgggaacagagtttgaagagtttttcgacctcccaaagaagtctatggataacttcagtatctctaatgttaacgatggatcaaataagtaaagaactcgaagctatgcttaaacagtatcccgatttctacttgtccgtaaccgatctcttatgcttgtatgtgttttgcttcaggctgtggatccacttttgcgcaatatacatcttcacggcggttgtttgttctctactttactatgtaagacgccttttgttttgtccatccattctactttatatcgcctatatgggaacataaaataatgtttggactatctttgcaggagcacaagtacattttaacaaagcggattgctcatctttattcatccaagcctcagccacaagaatttacagttctggtcagtggcgtccctcttgtatccgggaacagtattagtgagacagtagaaaactttttcagggaatatcattcttcctcgtatctttctcatatagttgttcatcggacagacaagttgaaagttctc

SEQ ID NO: 5301 - DNA, 416 bp, Arabidopsis thaliana
acagacttacttgtcctgtttgttgtcttcatgtatcataagatgcgttagacaagtatctgacctaggtaaccgaacttataggcgaagctatgtggtgtacttcctttgtttaagttataacttaagatttgtcatctagtgtacaagtaattccgtgtgtatgtttgcttatggaataaataaagaaaactaatgcttatatttaatttcaattaattgtacgtggcactttcagagtccatttggtgtacaaagctgtcttcttcagtgtgacacctctctgcatcctcaagcttccatttgtcttttccagacctttcttctttccattaagtttcttcctttgtgatcctagaaaaatctacttcttttcgctttttgtttttgggattgttttcattgatcctttcaag

SEQ ID NO: 5302 - DNA, 822 bp, Arabidopsis thaliana
aaagcagcctttatttatgtttacttaaacataaaaattgatttgggatcagaattgagatagaaattgataaggtactcttgaaagttctctcttttctcaattctcttcatcatatttggactcatattccaacgacatcgttttgggaatccccatgattcttgtttgcttctatctgtttttcttttccagtgcccaaaaataaaataaaaagaatctttgtctacattgattgaaaatttgatgtttttctttttgcagccattcaaaatattggtggcttcaaattcacctcttacacttgtagcttgtgcttcatccaattctttgcagcgattaaaacacacaaaaagtttgcatatgaattgctgactctgaatttctcaaaaaggtaagcctttttttgttcatatcttgctttttaatctcagatgtatttaaatgatcgtaagtatctgtgaattggtccagtatgattaagagattcttgacactttccaaagatcagaggttttgattttcttcttgagctaatacaaattttctgatcgcaatattagctaatctccaaatccaaatcatttgaatttgttttcttttttgccacttatggatatctctaaggactaagaatgaattgagagatgaaattagggtttcaactttcaatttgaacagggaagctgattttttttttctagaacatcaatgtatcttagactcttacacatcttaattcctaatatagttgtgttattcaaagaaaaaagcttctctcttatgcagataagggcattgcttcattgatatggttaagaa

SEQ ID NO: 5303 - DNA, 1187 bp, Arabidopsis thaliana
gtttgaacaaagttattcatctaccatacccatttattcatctgcactgtatccttagttatttattccaataaacgctgaattttatccaacccaaaaataaataaatagaaatttgtgttcgatgtgtgtggtccgctgatattggtcgtcactcgaattattaatgcatgatatggatttgtatgactgtcaaatttttggaaacttcactgtcaggtacgtgtgtactatatatgaccacaaaagtgcattttatcatatatattagtaaactaactgtaggtaatttttttattttaaaaagtgtaagcaataatgaaaattgaaaaaatgagagtattatgctgcaaaaaaacattatagtaactggagtatctctgtatctgcaatcaacaaaggcttaattacgagattaggctggtcgtatgtctccgttgttatatcatagggatatggcgtacgtcaacatgtattcaatccgtaataaaaacacatatataacaagtatcaattgacggcaaacaaaatatagtatataacaaacatatatatcaataattgagtcaaatacatctatcagtaaatgttaatgacaacgacaaaaatcattatcatgaaaatctgttatttgtataattaatgaatgtttgacaaaaaaaagtataattaatgaataatatcaaatgataatatgcttaaatcgtacattcactaaaatatcttctactgtatttatagagttagaattatgacatcttcctatataaagcaagtaaatttgtaaacttatctaaaagttcaatgattaaacgtaaagaaattacatttaaaatgatgggtccattttaacgtagcaatcctcatgatctgtacggaatccaatttgttcaatgtctatttgtgggccgttttgctaagcaagccaccacatctctcagacacttgacagctcatcatctcccccttgtcaatcccggttcggtttctgatttagttcgatcttcgattttagttattaaaccggaatctcccctaacaaataaaccgaatcctactaagagacgtacgtatcacacacaaatcttgcggctttgcctctctatacaaatcactcttctctctcccaatcactccctgcaaattttcttctctccctctcccatggtggttcctctatttcaatc

SEQ ID NO: 5304 - DNA, 2000 bp, Arabidopsis thaliana
aaatttataatcttatatactacaataattaataacatattagatgtgattcaatttttgatacaagttagaaatcctagaattgcatgtttagatcgatattaatacaaaatggtatactataggtgaaactcttaaattaacaatcaaagtacaagtgtataatcttaaacactaaacaatatagataatatcaacaaaacatatacaactcacagtttactatacatttaaaatcaaataaaataatatcaaatatttttaaatcatctttacaataaaaaaattttagtttaactaaaatatatactgcaggttaatatctagattatagggcttattggatctaaagacggatcatcaaagattttttaaactgaagcaaaatatattgaatattcaaatatctatctgttaccaaattataaacaaataagtcaatttaatattttatatacaaaatcaattaaatcttaatcacataaaaattagcacaaaaaaagtattcatcaattaaaaaattatcaaatctctgtgttatataagttttgatactatattcgaataaagtgtaatataccttttcaatttgtattctttaactaatttaagctaactaatatatttgctaatcttatacctatcaaaactgactatcgtttcttatctctatagtatttttgcaagacttttttggtggatttggataaaagtgcattcgggtcatatgatacattctcctattaaataaatatggtgcactcttatgttattagctaaaatgtttagattctaattcagagtcataccattaataaaattaatattaacaaaataaatagctttttggcaagacggatttggagggacgggtttttgaatcaacattaataaaaaagtaaaatataattaatcgaccgtttcaatacgggttaaatctttaatttattattttttaagaccactaatattaaacatatcaaatcatcctaatttagaaaagattatataaaaccaaaaatgttatgtggtatgtataatgttactatatataaaattaaactatagatataaatgtattagagaatgatacaatttgcaaaacttttctatataaaaaattattcttaaatgttaaaaattactatttaaaaaaaaaaatcatgggacggtaaaaaaattacagaatgagttctattttggaattgggttatatggtggatgtatttgaatcaatatttataaaatttaaaaatattattaatatactgttttaataggggttaaaacttcagttttttaacaattatctcatggattcgtggtataccgttacttaataacaattataaactgtaaaatataaatatttaataaaaataaaatttgcaagttttaatatatattacttttaaaaaataaatcgtcccgcgatataccgcggttaaaatctagtttgatatttatgaagttgtactcaaactcaaaggtcaaaaccaaatgctataatttcatctttgtaatggacctacaaatagaatcataacgaagatcctgactgttgacctaaaccgtggagtccaccagacatatgacttgttgtcggcaacactttggtttttagttaagattaagcccaatagcccaatataagcccattagtgtaggccctattaagtccatctacactcgaaaacttcatcatcatcttcaaggtttaagattggcttcatgaatctccaatcactgttctcagatgattgtttaatcttatctgataaaaatcatttgcttccataattgttactgaatcgtgcagaactgatcaatcacgggtcccaccacattgtttgtttcaagaagctattaacgtcggctgattccaaatggtgatgacacatttttcacgtctccgacaacttcttcttctccaacccaaattcctctcttctcaacctcgtcctctccgttctcctcctccaacatttctccgatcagtg

SEQ ID NO: 5305 - DNA, 990 bp, Arabidopsis thaliana
aatctaaagcaatcgctaatcaatgcactaaggctgccatagacgcaattattatacacgttgtctttacgtacattcacaagttttagtcatggtttgtgtaataaatgaatgtgaatggtctatccaagtgatgtaatgtgaaatcagaaataatgaaagtgtgacttttgctactacaatcatgttttggtaatacaatttgactaagaaagaagaaacgtgcgagtttggttgcctcattgttgttgtgaatttggtatccacatattcttatctgtttactatgtggagagcgttccgactgttttgcggctaatctagccggtcaaagacgaagtctgaatgtgatgaaatgtcaacataagattttaaatgagctctggatgtgacgtgtttaatattttcacatgtacggttattagagtaaattatgatagttttaaaatttggaagcataaaattatgatgcttaagaaaatcattatctgttattctatttctttattatataatttattttaaataatattaaaatgaaaaaataataatagttttacaatatgattttaacaaaaatatacaattaataagtcctttttggtaaggactcacataagttttttggtactgctcatatacattggaaagtaggatttagtataaaaactttctcatgcaattatatagaaatgtatattaaaaaaaaaacaattatttcaggtttttcatgaatcatgatttattttaccaccgtgctattatatcagggatataaagaggcaagtggttacttttcttatcaatactgatctcaactcgtgacccgtggttgtcatgataatttctagacccaacgataaagataaaatagtagcatcgcaccacaacaagtgttgagcatgagtctatatatatacacatacgttaactccaaagtgaaacaaagagattagaaactacggagagaaagagagaagatatatagcc

SEQ ID NO: 5306 - DNA, 2000 bp, Arabidopsis thaliana
caatttttttagttacaatattaatataaaattatataactttaatactaaactaaaaccgtaaaattcatattattatatatatatatataaaaaatatttgtcccgtggtgtaccacggattaaatcctagtttaagatttatttttgtatcatttattggaagacagaacattcaacatataatagattctgctgatatggtcttcttattgttttacttctttctgatatatataccattttctggttaaaacaactattatgatattaacaaaggaaatttcgtaaaaattatacataagataattactcgatcataatttccgaaacattaataattttctggtaataaaaaatatatataaaaaattgtgaattgggatatagatgtgttgggtggcctagacgaatagggaggatataagaacatgtgcatgcacgttaagctaatatacatacaacgtgctgctaacaagcgatcaatttcgaccactaaacactccattatggctacttattatatgtataaacctaccttaattagttaggtacttttcacgttaccttgaaacctataaaatatagacatacactgatcaatcatatgcgaatgttaagctaattctcatttaatgatcaatttatatatctcaattatcagagacgtacatatatgtctaagagaatttgtaagtacaatgtttcgtgttgacggcgatgggagatatacattgaatctatagtctccgaggatgtttgatcaacatcgctccacgaatctgcttttctttttcttttcttaaaaataaacacatgacgagaaagaacataatcttttaaggtgcttcaatcaaatccactcactaaaataaaaatcctaaatacgaaagtccataaattcaaaggaacacagaagatcactgcatgttcttgtgtctttttatattaagaccttatcccattatccaacatcgttatctactttgtccaaaaaaataaaacacctagaaatgcttttgttatatcattaggttattcatatttcttaattagttgcgccgggttatatcagctggaaataatgagatatataacgacttgataaaagcaaaagcattatgacaaccaaatagtcatattttatctatcatctccgtcgacagtggtgatcaattcaaactatatacattgtagcgaaactcaaacactaatatattgtatgtttctaaattagtttacgaatcagaccaaaattttgggagaaatataaaataagataatttttcgatagttgttttgacttttgctaacgcgcgcggcataatatgaatattttctttttcatcttatcaacctatatatctgtctatttcaatcgctagcgtcttaatacactgattgcatgcttataaattagattaagaattaatctagaaagataatggcataaagataattatattcttcgttaatgcctgactttttttttttggtttgcttcaatccgcccgactttgttaatctcagaacaaattggctgcgaaagtaaaataaaataaaatgaaaaaatggataaagcgcaacaaaggaggaataagacagggtgtttaaggtgatgtgaatgggaagaaagttggtgttattaagcatgtaagagagttgggtagtgatgataatcatgtgagtgcatgtgcatcgagttgtattttgatgacatgtcctctgatttaagctaaaccctaattatccatcaaaaacaacatttaaaacacccttgtggacacttgtcaaattctcatccaattcttttgagagataaaaggagaaccttctcagaagctgtaatctccattttaagctatatataaaggtcactgacctctatgtatgtctatataaactaagggcgtctcatactctcatatatatttgcatctaatcttgtaagcaaacgttatcacttgtctacacaacattctttcatttacaataataat

SEQ ID NO: 5307 - DNA, 859 bp, Arabidopsis thaliana
gttcccacaacaagagcagacaatgtaaccaggttttcgatcatattggaatagagaaaactcaagaggatgatctgagtgaaaaccatgtgacaccttttgcggcagcttggagcaagtcttacatatatcaaaattgcaaggcttacatgcgtattcaacaacttggtcttggaagcaaatgttgcagatgccttcagctacaatctccggcgaggtcaaagggcatgagtgggagaaatgctcgagttttcccatggggaagaagcaagattggaatcttgatctaagagtaccattagataacacagtaatcttgatcaaagaaccttcatgattcaaaatcccaaaagcataactaattgtgaggtcgacagagagagagagagtaataaattagtggctcaataattgtttctcaacgtggtgtggttggaaaatttaatattttttatttcgtttactgaccatgcttaattggattctattgagcccatttttttttttttggtatcattatggtaattgaagtaataatgatacttaaaattgttattgaatatgaaacttaaaaattgatgaagagtcttctcagtgtgaagtacctttcactagacagttctttattcataagcatgttcgataacatatcaagaagcataaatccaacagatgataagggtcaaagacgacttcttttggctaacttacgacacgtgaccaacaagataggtctagacttctgaagaactgccacgtcttggcaaggtggcaggttttaagaccatggcttgagggcataaataagttttgtggacaaaaggggaaaatgagttaagaaggatcggtatcatcaacg

SEQ ID NO: 5308 - DNA, 2000 bp, Arabidopsis thaliana
taataaatatatttactcggaacatctttttgtaagaaattggttaactttacaaatgcgcacattaaacctattttcgaaatgttgaaagaaaaaataaattaacttaatttgcatttggaaattaaatcaattatggaaaaaccgatgattcgacgaatcaaacagaaccgcgtcaagcaatgcctctcaaatcaatcgtgttcttaacgtgagagagagccccattgtttctcaaacacgatcgagaataaacattacaacaacaacaacagaaaaaaaaaacagagagttaaaaaaaaaaagaaccagacataatgttgtgtttcagatctcaaagagtgtttatacttgtgtctctgtgtttactctcttcgtttcttgtggtcgtcactggaacaacatcgattactggtaagacttagatttttcaaaagttgtttctccatttttttaatagttataagatttttcaatttgtgtttgattgattcaggggttggtaacgaagaagaaagaggtgtagaagaagaatggagaacaagtgtaatagaaagagtaattgcagaggaaagtggagagaactcatctctgattttagctgcaaagagaacaagaagaaaagatcctgctgataatttcaaactctacactggtggatggaatataagcaattcccattatttgactgtgagtcttttatttctgtggtccaaaaatgttttttttttgttgttgtgtgaaatctctctccttaccaggtgggtattgcttcatttgacttgggttcttcttagattcctaaattttgattaaagttataatctttaccatcaaaagtctagtggagttttgactgttttaacttttaaggtgtagttatgatgctcatgatgaattaatcaatagcataggattcacaactagttggtgcttggtttacttgacttgggttcttcttatattcctaaatattgattaaagttataatctttaccatcaaaagtatggctaaatggagtttgactgttttaacttttaaggtgtagttatgctcatgatgaattaatcagtggattaggattcataactagttggtgcttggtttacttgacttgggttcttcttatattcctatattttgattaaagttttcatctttaccattaaaactatggctaactgtagttaaattttaattaaagttttgattctatgactaagtgtagttagggtgtttggtttatttgactttgattcttatattcctgaattttgaactttaaaagttttgatctttatcattttgtaatattcactctggattaatcaatggaaatttggattagctctatgactagccttgttacttgaatcagttttattatgcttatatagatgaaagatgtttgataccaattgatatttttgatgagtcttttgtatggtattggtgacatactaatcaatctctatcattctttgcttgtggtgcagtctgttggttatacagcggcgcctttcattataatagcactagtctggtttgtgttctttgggctatcattgtctctgatttgcctttgttattgctgctgtgcccgtcaatcttatggttattcccgggttgcttatgctctatcccttatcctcctcatctcgttcacaatcgcagcaatgtaattctcacgagctattctattcgtcatcgttgtttcttgctggatatttatgtatcttgtgtttgatattccagtataggatgtgtttttctttacactggtcaagggaaatttcatgctagcacaaccgatactttggactatgtcgtgagtcaagcgaatctcacgtcagaaaacctcaggaatgtgtcagattatcttaatgcagctaagaaggttgatgtgcaatccagcattttgccacaagatgttctctcgagtatcgacaacatacagggaaagataaactcgtccgccacaactctttctgtgaaaaca

SEQ ID NO: 5309 - DNA, 2000 bp, Arabidopsis thaliana
tggtgaaaaaactccatatgaacagaatgtcgttttctgggatgcttctctctctctctctcctctcaagaattgaatacgaagataaaaaaaaaaaaaaaaaaaaagagcttcgatggacagaaaacgatgaggatgtctttctcaaagtttgcgtctttttttttttcctctttccttgcagttgcgggtaatgtaaaaaaattatttacctctgaatgattccggttttgttgctgtgtgctatgttcggtttggtttctatgcttcggttcaaccaaacaatctaatgattatggcaagcagaatagtaaaatagaaaaaatgtgtaaaacatctatagaacacatatgtatatacatgctgagcatctttaaatccacaaaaatactactatttgagccgaatctaccaactaaactaaacctggttttaaaattatccggtttatttgagagtttcaacaacaagcgcgcttagaccatcattattcatagtttataaggttagttcttagataaagtaggtcttaaatttaatgttataattcaattaattgttaaaaatgactcttatataagagccaaatctaatgtttcttaggttaattcttagataaattaggtattaaatataatgttttaattcaattaatcttaattcttagataaattaagtattaaatctaattgtttgtcatatttgtttaaaattttatgttatgtatgtttcaaattttttgagttgtaataattattaagttttttaaaattataatgtttctactttttttccaattttttttttaagaactcaagttaagagtccaccattgcatattgccaaaatttcaatctcttaactaaattcttaacttcaaaattttcaaaatcaattataaaaatattcataagaactattaagattatgctaagaaactactattaatgatactcttatgatggctatatgatataaaaagattgaccacttaccaggtgtgtttgctacgcgtgacttgaaagctctacaaaatgtttctcttaagtgggagtcgtggaggtacaaaaagcttttcacctttgcttttaataggatgaatgaaatgatttacagttatctgattaggttgaatttgtctcatggttttctggttaaaaaaaaatgctacgcgtgaggcttctttattgtgtttctggtcagacgtataaaaggttgaaacttcaaattgaaaatgtcgtgatgagctaatctagattagagtacgtttaattcgtttgaactcgggatgagcttaaaccaaactaaagatctttgtgccttttgggatatgactttttgttgtggactgtttttttgtttttgttgtggactgttttttgtttttaattagtatgtacagtgtatgtgaacaaaagaagtaatcagtgtattgggcttggaaggctcattcttgggatgggccttagtactaacagattcagaaatcttctatttgatcccattaaagttcactaacctgtactgtatttggtgaagaatcaaatatatataagtgtatatatatatatataagtatatagataattaatataattacatgcaaaattttaattatatagataattaaagtttatatattagttatatatatttataattgattgaattcataaataaactttaattatctatatataagtcagttctcattatccatatatatatgtatgtaaagttttgcatgttatttaattcaataaacttaattttgctttttaaaacattaaacatcaatttttagagaaagaaaagtatatataaaaagagaaaaaactaaaatggcatttgttataattttggtgtgaaaaggagggagagaaaaaaacaaaaaaacaaagaggatttaagggttacgagtcgcctccccaaaacccttgtccctagtctcttctgcttcttcttcttcaaaatctctctcttcaccaaatcctcagaag

SEQ ID NO: 5310 - DNA, 2000 bp, Arabidopsis thaliana
agtaccgacacaagagtgtatggagacgctacctccctccattcggtgacaagaaaacctggccgtcagacctcaactgttacctaatcgcacgttcatctactactgctccaccaacaacaaaaccatacgcgtcaattataaaatctcttccttctcaaaattcaagggcacacgaaaacctaaaagagtgaactttcttaaaatgataaattgaaacgctagcgaagaagttaaactcaccggaaaattcaaactgacggaggtgacctagggttccggcgaagaaacgaggtttggcgagtgaagcagattgggagagaaatgcccgataaattatattcgctttcctcggcaaatgaaatgagtctggtttaagtaaagcccaaaattaaataaatatttggagagaaaataaagatggatactgatgccgcttaatccatagtgacacgtgtcgaattttctggatcgtgtggctaatattgaacttaaacaaaaagacgcgaaaggttttttacttttaaattaacgtacgttaaaatttagtgtaatttactggctagagttccgttaaaagaaaattaaatgaccaagaggtaaaagaaaacaacttttgtttgacgtgactgtggtaaaagttagaagatttattgttgaaatgactattgactactgattagtgtaatgaagatgattggttggctaaacaaaatggaaagtgtcttaaggataaaattagagaagagacatgtcactcactaactaatagatagaggcttttgtgtgttaggcaattgacggattggacttttggaccatcagatcaaaaggaatccattgggatatttatatgggcttaggcccactttataatttttttctgttaggtttttttggtattttggtttatgaatgatagtatttgtaccatagatggtttggtacggtttcgtattggtattggttcgacttcaagttttaatcaaatgtttatttaacttgaaaacaaaattggatttaaaatcaggtttttctttctgtttgtttagtttggattcgaattcaatattttgaataggaaaaatgaattcataattttaaaaaaaatatagttcattttcagatcgattatttgagtttggacgtttggttcataatatcagtttactgggatggaataattttcaacttttaagcggtagtgggtggaaaaacatttgtcagggatcggtttaatctaggattgagcattccacttcgttgttctatactgcaaattaaattcatgataataaaaaactatccataaaccatatactaaaaatattacttttaaaattcatggggcggagaaagtattataaacaaccatcctctctgcaaatttttatttaatgtcaccactactttggatcacttttctaagatcttaagttttctgtttgttgcaattttattacatgtatatgccaatatctcttacacaccaactccaaacaaagcagcggtggtacatgaattaactcctaatccctattaatattttaggcgtttagcacctcccaaactaaaaaatacaaattgtaaccaaaaaaaatatatatagatataaaagaatacgaccatctatcataattggtgtgagacaacattagtttaaatgcaggatattaacatgacaacagaacactcttatcttcacatattatgaaataccttatccatcattttcatagcattataccaattggttgtctttaatcatcttcgatgtcactaaccctcaaaattcaaaagaaaatgaatagtctaaataattggcggtttgggcggcatccaattgtgacaggccacgtagagtgggaccaacaacttcattacctcgtttggctctttgctatatataaagtcaagcattagtatgcccaaaaccacacaaatagaaataacttgtaatcaaccaaagtcgaaaaacagagttattttgtcggatcaaa

SEQ ID NO: 5311 - DNA, 2000 bp, Arabidopsis thaliana
atttagataatttaataaactaaaatatccacataaaaatttcaaatttatcaaaaataaaacatcaatttgttttttgttttaaattaaagatttgctattgattgcataaggaagaaaactttacaaagccgaaaggcctaagagcccaacacacacaaaagaagaaccattttggatcaagggaaccgaccatgggtattagaagtagtggtataaagcccatcatatcccaacacataacccacgaatgtttaatattaaaagtttgttgttcggctcatgattagcgatgatcatacagaaagtttgtatctaatacgtgccttgaattttatgtgtacaacaaacaaattaaattattcaaaaccataaattataaaaaataattacagaaataaaactatattaagagcgagcctaccatccggtgtgcaactttctagtttatatacagtggcggatcaacgttaatgaggcaaattggttcaaattcatctaaataagactagagttcacaggttcgattcctccttataacaatttgctcccaccaattttttttgctgggtccgcccctggttatatatatacttctacaccaggtttgggttcgagtccacacataattaacgacacaattatagtgcacgatagaatgaactaaaacagctagagcgtagagggctcattgtctataaaaatccttcgttaacttgcaagaaaccaagagtagagggctcacacttaagtctcctacatgacgattatatttcgtcaaaaagaagcaattagttagctttacagcatatcatttcgcctaggttttccatcgtacacgtaaattttcatgcaagaaagcagaaatatacaaatactaacttttagatactgaaaaatgagatcagattctagtcaaattttgttaaaagtatttataaatttaaattgcaagtcctcaaaaagtacgactaaaaatgcttttcttagaaaatgataataaaccggcgttttatatataagtgtttctttttctcttctgtccagaagtaaatcattaagaaccaatatggcttttcttaaactaatctccgtgataatcaaatctttgatcattctccacacaatcccatcaacaacatcgatctcactagatgcaccaacaatgattctaatcggcactactaactatagagatagttgtcccaaaaaaaaaaaaaaaaactaactagagagataaatcatattcaatacatgtactatttctactatacttaagaaaatttgtataccactatcttaactcttaacactgaacatactatacactatcttaactcccaactcttgtaaaagaatatctaattttaagaaaagacttcaaatgcttgttaaatttctagtgaagatgcacattctaaaaactggtaaaatggtaagaaaaaaatatataaaaaaatagccttattaaaatttatatctcctatttctctatccaaactacacggatgaagcttattgttattcatccaccctttttctcaattctgtcctatttcttgtgcatgaaacttctccatcttgtaatcggataaatcatacccaaattttttctttctgaaaacatatatacccgaacattaattactatcgtcctttctcctaattttgttaagaaacatgtttgtttgtttttagtactgaaaaaggatggagatacttgctagatcctatgaaccttttctctctaggacaaatcagtaaccaaacaataacttagcaaattaagcacgacagctaatacataaaatgtggatatcaaacatgcacgtcacttccttttttccgtcacgtgtttttataaattttctcacatactcacactctctataagacctccaatcatttgtgaaaccatactatatataccctcttccttgaccaatttacttataccttttacaatttgtttatatattttacgtatctatctttgttcc

SEQ ID NO: 5312 - DNA, 2000 bp, Arabidopsis thaliana
ccctaaacatttcacaatacttagtcattgcaaggaagcaattggagattcaaatacctaaaaactcacctgattaacaaaaagagctgattttggaacgaaacccaaatccaattcaaagccaaaaacttctgcatccaaatcaaaacaagaattgtgtgttgaatcaaacaaacaaacaaggacaatgatgagattacagaattggcgaaaattgaaaaaaaggaacaaactttggagcttgttcttaccgattggagaagggtaaggaatcgaatccaaaacccgcgaaagctagagcgatgatatgcagaaaatccaatccaaattgaggagatagacaatagatttcgatttttctctctctctatctccaaaatctcaatgcccggatttatctctctgtttttcgtaatttacgcttcttttttttttacatgacgcgtaagggtttttttctcggtcataaacgcgtatatacaaacgcagcgattggcttctgctaattaaatatgaatttttatgccaagcatacgtccatagatcaattaattatgggtaaaaatatattttctaattttctgcaaatggtgtaataatattaaattattttttgtctacccctttgaaccaatgaaaattctataatatttgtgtgttaaatgaaaaatcgtacatgctgccaaacaaaaaattcataataaataaatgaaaatcgcatataaactttaatcaaatgttctgaacataacgtcccacgtatgttttcgtttgcttattcatatcggaagaagagtaatttgcgcatttcatattacaaattggggaaatggacaataaattggagagcaaaaatcatagccatctaacctcacacacttttctttttgttaggtaccagaaatatcaagaatcactgagctaattgtattctcatgactttttgtggtcagcaaatgaaactggtctgcaatagtttttagaagtctttatcggtttatttctcatgtgttttgtcagaaatttcttagaaatttttgtcttccaaacttggggaactaaatttgtttggagtgtaagaatacacggttgagcttttaggtaatacacttgtttttgaaaggtataatgaattttaaaaaaattactttatcaacatttaagatttggagacaattttgaaatcacgtttgaaaacgaattttttggccaattgttcacttttctgtcgttattatacttctgttaccttgtgtctatttgttaatttacttgttttatttgatttactccattgttttaaaagttttactggtttgttttgttaaattgatatttttgatggtattaattaagtttagtactacattaagaaaagaaaaaaaagagtctagtacgtatgtacacaccaaccagatatgtgaacaattatggcgtcaatttatctggagcatatatacttttatatgatggtttaggttgaaggagttattctaaaatgcattaacatcatacataatcggtgtaatgtagtgtccttaactatttaaatgagtgacatgtgacgcaaaatgcgtgacgtacgcaaatatgcagcatattatatgcttgtgacattattttaaatagttcatgaagttacaatgataagtcagaataaattacatactagtggctagcaagaaacaagtggatgatgtataatttggaatatgattatttctgttttatactggtgggttttggaataagaatactataaatttagaaaaaaggaaagaaaaaaaaaacatgaattataagtgatatacgtacgttgaacgagttgtagattctcgaaactatacacgaaaagaccctggtaatgatttcattggagagaataaagctaaatagctaattattgcaattcccaaaacgttatataaagaatagcaagtaagggttcataaggtaagaagcaaaacatttgattgagatacttgagatccaagataaat

SEQ ID NO: 5313 - DNA, 2000 bp, Arabidopsis thaliana
tcgctagaatattacaaagcgtttagaaatgagaaagtgatattaacaaagtaaaaaaaaaaatgatatattgttaagaacacataaaatagtcacactttctgcttacaaaacggaaatgtaacttttagttggcttttaacacgaaatattaagttttagttgcgcttcggacgttatgtttttttgaatcgtgttttcgccatgttcttttgtgcatagggaaccttcgattccaattccatatcgatcagtgtacctccgaagaacctttctttgaacgtcgtagttcatgttagccaatagtcaggaagactcagaaggtagaagtgttgtacaacaatgtttggcatttggcgtagcgtgatgaaattagaagcttgtttgcggttagccatgttgggctttgcaagtaatggcccatgaccaatacaatgctatgaacaaaaggcccatccgctcatgactcttcttatgtttctttcttaattaagcatagattactagcttatgacaaaacattgaagattgaacagtagttaaattacgttgaatagtagttagattgtacggggttttctatataagaaaaaatgtttacgattgagaaagaaaaacagaactataataaacttatgaaattaagctttagatagaattacatcactgttgtaaaattcaactcctctttaaatattgaaaagaattctgataacttctgcaaaagtgcaaaggactaaaatacgtatggggcgtgtgagacaaaaacatttaacatttatacgattctatgcgactaatttatctaatcgcctgttatagcgacgttattccaatttccaagaaaaatcatcccaatgttgattgataccatttaagtaccttacaagttactagtaaattcattttaaaaatgtattctttaattggaccgtcgttacaatgtgaaatccgaaaataaaatataaaaaaaaacttaagagacacaacagtagaagaaggaccaagtacacatgcccaaacccaataattcagttatccaactaatctaaataatattcatgtttttataattgaagagacaaaggagagaggaatgtgataaaatcataagaaaggacacgtggaggtacgtgaaggaagtagcgtgtggagagagtgattggagaagagagagatgaaaaaagacagctacctactcatcttcccaatctatctacctactttctcccagatctactttttttttgttctttttaacattttcccaaaattaggtttaagtacttttttttgttaataatgcagtaaacaattgtttaattcaataatgcaaaaaaaattggtttaattttccgctaaacaaatttattgatattaaaacgagtttacaaaatcgttacagaaactaagaagtaaatttgatgatgttaaaaacactttattcactaactgattagtgattacttaaaccgttatttagttattttctcttttataatcgatctttttatacgaaagttacgcgtgactatatttttttatatgcaataagaatggttaaaaacagtacatgttgcaatgaattgtggaatttgtaaaatgattatgatattttttttgagcagatgagatgattctaaagagccaaaaagtcaataaccaaaaccgtacgatctacatctcagaaaacaaaaaacaaaaaaagttaggaaactccacccacgttcctcctgtgagtgtactacaatcaaatttgtgttttctggttggtgttacaatattctttaggcacaaaaaaacgaacacatcatttcatttgttagatacatttttatttttaactttggtattaaaataatgttaggtagttattataaataacattcaaaacgaaaacaccatcctacaggaactctcttccttgcaaaaaaaataaaacactatttcctccaaatacacgtagagagatacatatatacatatagagatcaacaaag

SEQ ID NO: 5314 - DNA, 556 bp, Arabidopsis thaliana
tttgataaccgattataaccggtttaaaccggatatttcgtttggtcaattagatgataacataatattttcatacttttttaagtttttatattttgtagacatttgggtttaagagatgaaccgaattgaaattgaatctcgtttgatggttcaacgagattccggtttctattggttgttttcttttgaatctgaaacacttttctagtaaaaattttgagtttatattcatttgaattttcaattatatacacttttgttgagtttataaaaatacagtaaaataaaaccgatcactaatgccaaaaaagaatagtaaaataaataaactaaaccgaaaaattgaaccgacccaaatcgtaccattcgattcggagtaattttatctggattagtcggttaacatgggtttagtgatttaatagataaaccctagatttcttcttcacatcatcttgagctcagctcttcctctatctctctgcaactcaaaaaataagattgtgaaaaaccctaatcgtaatctctcggttgagtcagtcttaaggtatca

SEQ ID NO: 5315 - DNA, 769 bp, Arabidopsis thaliana
ttaatataattgttttgacgtaaaaaaaaaaaccaactctaatttttcaacatcatgctattgtagtattatcaatcacataaataaagaattagattcctacaaaaacaaagattttaataaataatttagaaaaaaaattctattaatacaattcagttatacttctttttaatatatatatatatatatatttatttatttgttgatactaaatcaccatctgaattgagtacaaaataaatgtcatggttgatcatataaataaaaatactattgagttttaatgaaaatactaagatctaatataataagtgacaaaaaaatattatagatatttaggcgatataaaattgattactttctccaagaagtaaaggaaaaaagaaaaacaataatcttcctccaaaatcataatcatttccatttgttgagaggcatgttagattttttggtactaactttatgaaaatgataaatgtgatgtagtaagtgatacaagtctacactctattccagttatcgcaaacccaaccgatccagtctctttagattccctttctcctagatcagaccacaaccatttggccacttctgtcctaatttattctctcatcaaaacctctattttgcttctccctttccttacaagctgttcactatatcccctgcgatttgtgtttcccacaaaccctaattttgcaagaagaggggtttcttctaatttatataaatctcggttctttttgccatttcgttttctctgatc

SEQ ID NO: 5316 - DNA, 1726 bp, Arabidopsis thaliana
attcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggtatcttactgaattaaaagagtgttttactattcccaaaagtgtcaatttctctaaattcgtgagatttgcagcaagtttatcatgacgccgtgagttatgttttggtcaaccggtgatagaacaagatattattgaagcagaaataattattaattcttgtatttatctagacgaaacttgattgcttgatccaaggaaattgttttgacttcaaaattgtattggttctcactacagttgacctgcccctatgtttccatgtggaacaagattcttcgtcttggtcatatggattagtattatttatttctaatcttatcgtgtaatgcatgtatgatgtatgttctaaacaagatgtccaccaaggtccaaaacgagaagagatgcccattacgctcgctctagatgctttgtgaaactcgatggactttcttctctttaaactcacataacatacatacatgatccaaaatccatgatcgttctttttttttttgggttcatttttcatggtttattggaagcacaaaagaaaccaaaaataggatcacagttcttggacatcgtttaatacaaaactagaggaagtaaacattaaaaaaaaaacttgaaaaattaggggaggctaaatcattttcttgacgcgcttgtaataggaggagcaattgtggtaagtggttggtgtgaattagaacccaattatcaactaagtcgagttttgtttaaaaccaataaatttcatatacaagtttgaaactgaacatataactttttctttatatatcataattttgagtataacggatataacattttacttaaatgagaaagtactattgaattatccagaagacgtgatccgatggaaaaattcgtatcacacatgatcttttctttttatggcacaccagattttgtttacatttataattcgatttcatctttttcttagaaaaaatggtcaaagaatgcagctggtgaccaactagtgaccatacaacaagaacaaaatctcatggactctatttaaggtttccataatttaatttaccgtatcacatttccagctaattacacaaaaccgtcgataaataattgtttatagaaagaaataaatacaagaaaaacgtcaaaggatagctactataagtaaggcagactttaggaacccaaaattctgttattaatttacaaaaactaaagagtttttcacttttcagtttctcttcttaccattcactctaaaaaaacagagtctttataaaaccgatctcagattctgaatctgaatcagaatctggatcaacataattttctaacaaaaaaaatggcttcgggtggtggtgacgatgggcttcgtcggcgaggctgttcatgcacaaaagacgatttcttaccggaagaatcgttccaaagcatggggaattacctaaaagcccttaaagaaacaccgagtcggttcatggatcgtattatgactcggtcactagactccgacgagattaacgag

SEQ ID NO: 5317 - DNA, 2000 bp, Arabidopsis thaliana
agtgaaaacataaacaagcaaaaattattcagcacaaaaaaattcaactacattaagcaaatgatgagagtttttggcactttgtgccattccagaagctacagtttaatatctaatttgaactaaagtttaaccaacgtgtactattttcatcttgttgattctttctactcgtatgggaccatctaatgcgaatacctaacaattattatatatgatataaaattataaatccatgtgaactcaaggttacgttcacattcatgactcatcatattgagtgagtcgatcatataattaaattcaacctacattcttacacgattctaatatagagttaagattttaattaaaaatgatgacacaaattagtttgaacacaacataagcatgttagtaacgtgcttttggggttatatatcattattttaggtggtattattgatagaatggttaagattttaggaatcatggggatttgggcaaatattgtgtaactaagtatctatgtgtcacatttcttatttcctttcaatttctcctgataaacgtaggaaaacgaatatatactaatggtgatggtgattgatcacaaccatatcatcgagaaacttcacgttcaaacgtaaaagacgagaccattatcgaaacaaactagtatgaagaagttttttttgttaatgaagaaggttttttttgtgtgtgaagaagttatatatctgaatgcaaattataatgcaaggaatgtgtatctagccaattttgttgataaaagattagccataactgaattaaatatggattttttttttttcgaaaaatgaaatatggatgttattatgttagcatgattaagttaataatgttgacatgttgtaatggtactatgtcagcaaacgtgttgcatgaaaaatttatacggaatatttctatcgagtattaatttcaagatgcgactttcttattagaatattagtatattaaaaacaactagtggtggataaacaaacattattgtaagatgtgttgttaattcttaatttgagtactattattgtcttttattaatatttttgtcaactctatgtgtttgatgtagataagaattctttggccgtattgattattttccacgtttgaggcatcgatgtagttgggacgtgatcgtgaaatgaatgcagtcagtgtctccaatctgtcatccatgtgccaataaatccctgaaaagaaggtgacaaaatcttcaactaatttgtttgttaatttttactactaagtatacaattttactagttacaatatactatttcccataatgaataatcagttgtaaatttgtaataggaaaatatagtaggtaagcatttagatggtaaatttaaataaataatttggttaagaacaatactgataaaataaactatcaaatactaaacaagttatttaaaataagctaagttattttgttgtgtattttcgaaaagtctatatatctaaaggtgtcaaataaaagtcacataatgtttcgaaaatcccataatagtaggtggtatttttagaaataatgaaatttgggaggaaaaaatcactaatactacttactttgtcaactatatgtagtaaaggtaaatattaacaaaattacaaaagaaaacaaaaagtcctacagttttagtaactaactaacaaagagctttaaacacgtgaaaagtttttgcataaaactagtactagtatattagaactaggagtagtgctcaatcaacggccaagtcaaaacaaacaaatcaccatcaataatcatataattaataagcagaatcatcatttatgtatttgataatgttcaagtgaggaagaagaaggagacaaagacgaccccaacataatatctatcaccttctctatagatagttagatctcagaatctctccttttttgtttgctttacccttatttggccattcctgtcttccactttgtcatcttttccctttctg

SEQ ID NO: 5318 - DNA, 2000 bp, Arabidopsis thaliana
aacttgcttgatatcatgaataaaaaaatcataatttgtgatagataaagaaattcaattttagaattttgggttaagtattttgaaatataaaacgaaaatttatttcaaaattttttaaaacgagataagatgttacaaagatttatatttactatgaattaaactaaaataattaatttaaaataattatcattatgccttacatttagaaatatctaaacaataaattgtacatactaattttgaaatattttgggttttcttttttctatttttcaaccggatcttttgttagaataaatctataatatattagtgcacaaacttttgaaataatataaactaattatacatttttcattcagaacaaattatctagcaaaataaattgcttttgtaggtgtatttcaaaattttaattatattccaaaaatcctattaattatgattaaacaagggaaagaagaatattgaaaatctaggtaaggaaataaacattattacatttgttataatgctattcatatttttgaatttgaagaaggaaaaaaaatcaagaaagggtatttttgtgttttaatttgtgatatatttgtaaactttaacatcctatatgttaatccgcaaaactcagtcatatataatatgatatttaaaggtaaacaaataagaattttggaacgtacttttaatggaatgaaatgaaaataggaattatgagacacaagcgacatgaaaaaaaacggaagcattatataaaataatttgaaaccaaactggacatcaaattaaatatccaactggtatgagtttgggttatgagcagtatataaaataaattaaccctgcatgtacgtattttgtgacacaaattctatttgtgatgggcgctggtagtatttttatttcacatatacagacgggttatgggacgaagaatttatgatagatacatcacattatgggttttccgttccaagaaatatacgtcaaatatacgttttaattttctaaactaatcaaagcattataatagtttgattactggtgtaaaataggatataaatttggttttagtttgagttatttcccagtgtgagtccagattttaaaatataactatacaagaacacaattgaattttggttgttactcttacctttataatatctatactattacaaagtttacttataacaaaatattatatatattttaaaaatctattacttttttatatattttgcacgtatattcgagtttagatatctaatacattatactataatatatatcacaaaataacaaaataatctacattgaactaaaaatatgaaatcccaaaaatatgaaatcccgcacgtatgtgcgggtcaggatctagtaatatttaaggttaatgagttttgttacaagaaattttgaatttttagcttttatagaccaaatcaaaattataaatctattataataatttaagcattagtattttagtaacaagtatacagtgctcaacaattaacaaggtaagtaatacgaaaaaaattatatccagatctaattgttagtgatcccacaagttacatgtacaaataacgagtaacaaagcaagtaataggataagcatcaaaataaggcaagtaacaagacaagtaacggggtaagcatcaaatcgagacaagtaacaaggcaagtatcaaacatttttatgactgagtatttgcaaataataaaataaaccgacaagttacttgacttgcctatgacgagtatttgaattttcaagatgaatacgagccgagtagcgaataactgccgagtaacaaatacttgagcccaggcctactttttataagagctgggatgccctttaagagtgctgaatcatatgataaattattatgaacattaaaatatatgggccgaaatcatctgataaagaataaaggcccaaaagcccattaagaataccaagaaattttggaaaatcgagaaaa

SEQ ID NO: 5319 - DNA, 354 bp, Arabidopsis thaliana
ggaatatgaaatttccgagtttgtctggtcgaataggtttgaaaagcggcgcaggaagaagatgaagaagtgaagggaaaatagtcgtaaaacctcctccgccgcgtttcctctgttagactgttactgagttttttcaatgtcccagacctgattgatgactccaatattgggcttattttgggctacattcttctttatgggcttaataattgggcttttctattttttgtcgaaaaatgaaaacaaaaaaaaaacattttaaaaagagaagattttgcaattattggatttttgccattattggatatttgccattattggataacagttattcgtctgggttcagtgaag

SEQ ID NO: 5320 - DNA, 704 bp, Arabidopsis thaliana
gctttaaactttaatagaggggagaaagatggatcaatccattttgtcaaagtcatatatgtaagttacttccagtctccaaatacatgatgtaacatgatacatgtttcttcaaagcagcaactttgttgactaaatgcgcgcgccatcgagataaaatatcagattttttttttctgaacaacctctaacttcaagtgagcaaagaatgtgaagcagttatgctgagcaatgcaagacgcttatcatcatcatatatcaaaaccaaaaataaaacaaacaatatcatcaaaatttcttttaaagtaaatcttaagacaagacaataacacactagtcataactaatcagactacaatttataaacgaaacataatcagcaaaattcagttaaacaaatatataagtggcattgtaaaaacatcatataggcttcaattgttttactttgttcaaacttaaatttcgttctttctattttgggttctttacaaaaaaaaaaaaaaaaaaaaaaaaattgactgcacaagtgatgatgatgaagatgcgtattcattcggtggatgctatcggaaaggaacacgaattttattattaaaaaaggaaaatgttattccttttttgcttctcttgacttggcgtaatcaacttcgccatcttcgtttttgtttcgatcccaatcgagttttctctcaatttgagaa

SEQ ID NO: 5321 - DNA, 1121 bp, Arabidopsis thaliana
aagcaatgatcacacatgtctacaaaagaatctcattgtaaattttagaggttttaatattcaaaaaaaggtgaccttggttattgtaaaacaacaaaacaaaaaccatttaatccttatgcacgagggatagagacagagatattacttcaacagtacggcacaaatctccaaaggcacgacgaatatttgtgttatttgagttttgacttaatcttcccaagccaatacaaatcgagagtgtggcttgtttctcacggcctttgaattcttttttatctctaaagttgttgtctttcttttatcatcaattgtgtgttgttgacattgtttctcagccaaagtttgagactttggatcgaatcacttatgcccagatgatctctgcatgattaatcacaatttctttttaaaaaattgtttagtcttgcactatttaaggtttgaccgcttctacaataagatatgcactgaatgtgttcgacgaaatgactgagtgagatttaactttcaaatattttgacttcgtgcggtttcttttttcaacagatttaccaaagagacatgttgaagcgactcgagaaagtaggtacattgaattgctcttaattgagagaactgtaagtaaactaaaatttgtgtactgtgttattattattaagctggcttatctaatagtggttttgtcattatatcactcttaggagattattcgagaaatggaaagcttatgtaacatccaggtaaattctgcaaatgggtcctgtttaattgtgttaatctctttcatggaatggaaggtgacaagtgtgaaagcttaaaagtatttttcagaggttggagaaaaagttgacttctttttagacttaatgcaattggaatgtttcaatgttttattgtttattctgtttaatattagaaaggaacatattgcattattgtaccagagagagagctgaactttgaataagtcaagttttgtgaacaaaagcttggtcaacttattaggtgtcttaagtagaagcagaccccatgaatttttatgtatatacatgaaacttgaggaagattgttctctcaattctttgagttcaccaaaataacgttttttttttgtcaac

SEQ ID NO: 5322 - DNA, 627 bp, Arabidopsis thaliana
attgattaacaacttgtttaagcttattttaagtatttgtgtggtgtaataatatgatgatgtggctttctttcattgagtcgctaaataatatatgtaagtgatggatctttgaattaatataaaatatctacttctggtttcgtttatttatctttctatcgcttcaactattccatgttattaaaatacttgtgagttgtgacacatacaaccacgtataattcacatgtaattatttggtaattcaattctttacaagtttatatgttcttttgcatacaagttatcagggaaacgaccgcagttgtttggcaatgtatattactcaggttttcaattcaggcccatacggcccaaataagttgtttttacggatatcgagttaaaagaggtgtgtcgattataacggacatgtgtcacactaaccacaaaaccaacgtcttacgtaatcgccacgtgtgtcacttcaacgcaatttgataataatcataatactatatgtgattatgatccctatccaaagttgcggttctataaaaataccattcaagagcgtatacatctttatccatcagtgtcttaattttgtctatagctaaaaaaaggttcaattgtaaaaggaat

SEQ ID NO: 5323 - DNA, 2000 bp, Arabidopsis thaliana
atattgtttccttctcctccgatgactaacacaatgtttctatgaccaacctttttcgatgaatccaatggcattaattaaacaagttttgatgaaagaaatctaaaccctaagggatgatgtttagggaacccaagggctctaattttagatacggatcgaatcatctaaactgtaaaggataatatctaaagaactcagaataatcatgtatacaataactaaaaagcaaaccgattgtgaatcatgagcaaatcctaagtattttcatcaaaatcgcatatgattcacatatgagaaaaagagggcaaattagttttttagagaaaaagatagtacccatccttataaacactcaggaatatgtctaagttcataatagaccatactttatcgtggtttttccataattgatcccaagtaacaactcatctataatttatatgaaggggacatattgcatttatcttccctaaaagagtttcttatgtcaagaaaaaaaacatttgacaaatttgtcttaaaataatcaagggcaattctttcttataatatgcaagctattaactttaaacatacgttttctatttattttacaaaaattgctatccctttttatatgtttgtggcagtatttaagaaagtgtgctaggcggccgtctaggcgtcgcctagacgatatgcgcctttgtaccgtttccactttcttaaaatcggttttattaggcactcgagtaaatttttgcggactatgcggattttaaatggattagacggtcattagacggatttaggcgggtttggcggatctaaatgtgtcttaatattttaaaaatgtttttaaaatagatatttaaagttgtgtttaaagacacctatatttttcattattttattttattttagtctaaaatgttaaatttaaatatagtttcaaagttttgataatttttagcttttcataatagattgtcaacatttaatgtattactatataaatatatattattttgttataaaaccgtttaaaccgcctaaaatgcctaaatcccgactaaatgttttaggcgctaggcggagggtcaccgcccgcttagcgcctaccgttttcttgagtacttgtttgtggttgaattagtacgtattatctctcgagtacttaataattttaaatttcatcaagtcgatttcatataaagtagagactagagagcatatactctaaatgaagatctgttggtaatttatttgcaggaatgactgatcaaagtagtaaataatttgagttattccttcaacttttcaatagcgaccatacatcccagattcgagtaacttctatttttaactcttcaagttatctctaaaagaaaattatgtttaaatcacattagatatgtgtatatttaagtgggctataattgagtaataagtgcaacagaagacatggatggttaaagaaatatctggtccaaaagatgaaacagaaggaacagagtgtgacatcatgaacgtgcaccgtaactatatatgtcacaaaccatgggcgtacagttacacaaccaatagataaggttgatcaagtaattaggcatatgccatttgtagaaagctaaagagtgtaggatcgatatgcatattgaagtgaagagtaacatggcgttcatgtgctcacagctaattaacctcaagcacacttaatgtcatcatcctacaaaactaccaaaataagaccaacatctttttgtttagccaagcactttccgcctaaagcaccaatgcgagcaaggcaacaaatgcgatgacgagaggtgaacaagcgccgatgtttgtgcccacgacttccccacgaaggagaagccgcgggcaaaagtgtaaaccaaactcaacaattccttcaaattaggtacgaaacacaggccccggaactcatcatcgagcgtaacatcgcccgtgaattaactgagaaggataggtggtaggtagttcgatgcgcgagc

SEQ ID NO: 5324 - DNA, 1055 bp, Arabidopsis thaliana
tttaagatatctgatcataggaatgccacattcagatggaagccagacaccagaacagaaacaaagttgaggtaatcaaagaagccatcttgagagcaaagtggttttgattccaagaactcatatttatcagcataacctctatgttcatgaaacccagaagagcacaatacataactatcaccactcaatctgttattaccagaactagcagtgttcaacttcactcaaatgtggacgaattacagtaaattggctaatcccactactgaattgaccttcaaggtaaaccccaatcatttgccactacgatcaaccaaaaatatagattcttcattcactcttatcaaaagctatacatgaaattcagagtgttctcattcctaaatatggaaagttgaattctatcaacacaatcagatcatgcgacaatgaactagaaaccacgaaccagaaattgttggtaatcgtttagtggacgagattgaatcaaaggttcaagtggtaatcgttttctcctgacgcaaaatcgaaagaaaaaagatcggtagcgtcgcatcctaatcgggtgacccggaaaccaatagttgattcgttttagtggcggtaaaacccggtttgatgaacaaatattaatgggcctggcccatacgaggatgatcgtggcaatgtcgatgataacaacaactcctctattcgggtttatgttgacccggaaaacgaaagcataggacacgtgacacatgtgatgtgagtgaagccaaaaataataatattgggaaaggatgaacacagcagctcagctttcgtcttctccgtcaatccaataaaaaaatcagcaaccgttgtttgtttttaagctttttttacaaaagacgtacacgtctctctctctcactccctctttaagatcagaagctcatttcttcgatacgatcaaccattaggtgatttttttctctgatcttcgagttctgataattgctcttttttctctggctttgttatcgataatttctctggattttctttctggggtgaatttttgcgcagag

SEQ ID NO: 5325 - DNA, 586 bp, Arabidopsis thaliana
gtttttgatgctttgctatctctctgctcttcctttaaggaactgaatcaaacattttttctttactcttttcttagtccggtttggtggtctttttcagggaatgttgaattggttttcttaaagacttttggattattttttttcttattcttttcatagacaccattttaaaattctaaaaaccaagatcttcatgatatatagtttgtctcttcatttgattttcttttttctatatggtaaagagtttaatttgaaggaattttgagttttgaccttcttccataaaattagatacgtgttgtctgtattttgaaccaattggttctacaaaaaaagaagcagatatataaataggcccaaaagggcccattataagtttatagggtatatgtggcctataggccttgtcttagacccatttagttcttctctatagaccgtctctctttcggcgtctcgtataaaaatctcatttgcttttctacaaatcactcccaaaattctctccatcaatctctcttacacactacacaaattcaacaactgaaaccaactcagagcaaaagcttgatttgacact

SEQ ID NO: 5326 - DNA, 2000 bp, Arabidopsis thaliana
ttacatgatataataattacaatcataataattttcttaaatgacgctttctatatggagtattttcctttgtttgttaattagtgccatatcttttagatataaaactattaactatgacttggtaattaatacgtatagtcaaatactaggcatcctacgttacgtttctatgcatttttttatataaaagtgtaagaaccaatactagcttaaaaggaaacgagtagaatttcgtaatgaaaaaagacttcaaatgttaccttttaaattcagtttatgtttccgcgttaccttttgaaatctcgttgctttcgtacgaaaaagacaagaaaatagaaataaattagaaagggtggtttggtgagtaatgggtcgtatatgtgggagtcgttatcgtgcatgtgaacaaaatatggccatgttcgagacgaatcatggtgtcttttaatttggtgactacattattttaacactaatcaatatctttctcgaaccatatgatcatgattagccgtttctatattttctcttttaaatagattatatatgggaattattagccggaactttgccgctgcggttggtaataccttttaatacacttatgatttgtctctttattcggttcctaattcagtatacatattggggcttgagtttgaacggaaggtatatcaatgtcataccaccaataataatcagcatcatgcatggtttttaaaatgtggaataatatatacttttaaggacgataatgagattatataattgaaaggaattagatccattgagattctaaagctaccaagacgaggaacatggaagacgtggcgcattggattcttcgttcgagtttatcatcatatcatgtgactggtctctctttctttgtactcacactaacaaaacaaaatgttaatatcccacgttaaattaaatgattagaggccatcaaaggataaaaacaagaaaccaaatctaatatactattttataataaaaaattaaaagcgggtttatgtaagtgggccaaataaaaagagtgggccaagaaagcccagaccataatgaccacatggagaccgaaaggttgacccaattagaaaacttgttatatctttaggagtcaaagtcaaagcgcgtttacaaacaccgacactttctttgtcaactagcggttaccgcggttgttcactaggcacggaacactcgatttcttcccaagaagtcgcaaccaacacttactatgtatggtacatcacaacatagacaataaaaactcttggaatgttccgcgaaacaggtgattattgactaccatgagtggggaaatgtggggtaagttaacaagtacactgcttcacatgggaaaaagaaaaatgagatacacataattcacaaaatataatttttatcttagacaatttttttaaaataatattaaaatcagtgtagaagtggtccccaccactattttgtttttccttaaaattaattattatttttgctggactaaataaaattggtttttttttttctctctctgtcctaactctttttctttctctgttttgtatctctctctctctctcactctttgtctctcccctaacctttattgtactagcataaccattaccatacatactcttctctatcacgccacaaacgcagattcatcacatcttcttcttgttcatagcatctccatcactattgggctctcttcaaaggtgtatttctggggttacttattccttctttgtattgattagtgttgaaaaggtgtctctgttgcgttcaagagctagctttagggctatatattaagaggtttccagaggttttttttggattataggcatctgtgtttggcttacatggatcctttttttaaggttttctgggcaagactaattgattaggaccaaagtttgtgtttttatttgtttggatctacaaagatcaattaggctgttgttgaattggatcgagtg

SEQ ID NO: 5327 - DNA, 2000 bp, Arabidopsis thaliana
gtaagagttgcaatttaattggcgatcacttgcagcagctaaaaacaaaatttttagcgatagtgacagtcttaatgcattatgcatgtaattggttcgtacgtgtatacttgctggtgcaccgcttaatagactccgaatttgactcggactctttgtgcgttggacgcgcgtcacaggtgtgtctttcggtcttgcttgtggtcgcaattgtatgtatcgttgtttttgttttgattgccaatatgcatcattgtttccataatctatcggttatacaatatgaaacgcatatttccacttttattcaagtttctgtttctaagacacacactgtcttattcaatctgtttcatgtcaacgtctatgactaggttctatgtgttataaataacttgcaacttcaccaaaaacataatacatttttttttgacagccaaactacatatatatcctgcaaatgataatatttcaaattctaacacaattttacaagaaatttcaaccaatcaatcaaattatttttggtagttggaattaaaattcaccaaaaataaattcgtgttttcattcttaaagaagaaacagaatcgtttagaactgattttagaaaattacgtgattcatttcagtttttgttatcaacatcactagcttcaatcatgcatgggctgagcatgtaacgcaggtagagatgtcaaaatgggttaaaattcatgggttaactcaactcaattcaacccatgaactctaatgagttgaaaattttgactcaaatgagttaatgggtcaaatgagttgatgagtcaattggtttgatgagtaaaatgagttgggttgtaatggttaatgatttcaatggtttacccaattaacccatcaagttttgtaaaattgaattaaaccaactaaaatttctaaaccaatgccaatttaagtttaaccaacacatttaaaccaatttaataaaattaatatttttccaaatttcttaaatatacaagcgatgaaattgataaaaagtaaactcgtaatttttcactaaaaagataaacccgtgattttcccgccaaaaacgtaaatccataattttcccgccaaaaacgtaaactcgtaattttccagccaaaaacgcaaatccgtaattttcccgccaaaaacgtaaactcgtaatttcccgccaaaaacgtaaacccgtgattttcccgccaaaaacgtaaatccgttattttcccgccaaaacgtaaactcataattttcccgccaaaaacgtaaatccgtaattttcccgccaaaaacgtaaactcgtaattttcccgccaaaaacgttaacccgtgattttcccgccaaaaacgtaaacccgagattttcctgtcaaaaatgtaaacccgtaattttcccaccaaaaacataaacccgtaattttcctgccaaaaacgtaaacctataattttctcgccaaaaacataaacctgtgatttttccgccaaaaacgtaaacccgtaaaaagtggaatccgtaaatattttaagtttgatgataatgaattaataatattaattatttattattgttttataataataattaattaaattattatttaaatgggttaacccatttaacaattcaatccatcaaattaaatgagttatgggttgacccaactcatttaacatctaaacttatttgattaagagttgagttggattacccattttgaaacccctaaacgcatacatcaaataacttattgaattatgtttttataggttttatgaattcagtggctcgataatttattaggctgacaaaaaataagttcgactacagcccattagttagtattagtcaggcccattagttagtatcaatcaagcccattaagcaactttgctcatcctccatctttactagattcttcgaccttgcttctcctacctctgcaattctgctaaaccctcacggcgataaaccctaagttgtaaaaaccgtatcc

SEQ ID NO: 5328 - DNA, 2000 bp, Arabidopsis thaliana
gaactaccccattagttacttgaagatgaaacgaaacaatttggttttggtcttttggatcatatagttaaacgttatgtatcttactcagtttattttaatgaagtttgttgtttggtatatcaattagccttagatgtcaaatcaaaacgaaacaaaaacatgaaaattcaatttggcgttaaatcaaaataataattaatattccatggataattaatatacacttagcaaattaccgaagtacccttgctatctcgttgtcgtcaataatcaaaattacagtattaacccaattaagagcgtttagcgtctacgtgtaaagcggtatcaggagaaaggagcagcgatcacatgggtggcttaaatctatatcctccggttcctcaccggccaattattctcgcgcgtgtctccgctcctctctgatgcgcgtcactcaaaaagtttgagtcaaactccagtaatatttttgatttattttgtattttcaagaatttcttaaaaattgctgttacgtaatttacaatgcaatgtctcgcggtaaaggtagagccggaactcaagtcagatcaatctccgtgtatgattgtgttcgcatccaatgttaataatttcaggatttgtattttccaagttaaaggatactattgttaactaacgtatatgctgacaaaaaaaataaaaaaataacgaatattataaatttatatcagtcgcataatgaaatgtgtaatttcacccagacaaaaatatctctacagaacaaaaaaaaaacgtttgttatatatgtttattctgtatatttaaaatgtagtctaacgtttgttctatatgtctacaatgtgtatttatatttaaaacatattccatccttaatttgctttatattattgttacaccattcatagtaatggaagaaatatctattggcattctatactttatgatatatatatatatatgaaccaaagtattgtatgtccaactgggacattttatatgacggcggacgaataaagcttagcagatatatatgtacgtgctggtaactccatattcattattttggatttaagttgtaactccatacacaatacacattgatggattagcattgcattttttttatggcattttatatcaaaagattctcaatcaaaacttagatagattcctaaagcttgtaattaaagcatcaaacatatttgttaaccagttattatttttgaaatcgagtagtgttttgttgatgctacatattattccatcataaaaagaaaattaatgtgtgtgtaagtgtgtttgaaataagtcaatatcttagtacagtaattaactaattatacgaagaagaactataagggtaaaaacggtaattacagtatttggtcagccatagttattcccgctcgtctcttgaaaaaaattcaaaccggtaaaccattttggtcatacacgttacagtaacacggtggtctggtcttcaataataaccacgtcagcagcatacagtaaaaactactttaaatgtttttttttattctcacccaagaaaataatttatttttgttttgtcgttctccttcctaaataatttttcaactaccacaattaatttaaaaattaaaaatagagtatatttggaaaggcacaaaaaaaagaaacaaaattcaaaatctgaaatttctcagcctcctcgtttcttcacccagaggagagagaaatctgaggaattcgatcttcgcttaaagaagacgaaacaatctctctctctttctctcttcaatggtctcaccatctctgtctaccatctcctagccaaagaagaagacgagaagaagaagagagggtcacaacaatgctttattcttcttatgtctccagccatgtgagctcccactgacacattctctgcatcttcggaagttttgttttggtttgattcttctcaccgattcctgcgaccgagtttgaccctcgagtttcgaggttagtgg

SEQ ID NO: 5329 - DNA, 1969 bp, Arabidopsis thaliana
tgatcgcactgataagcgagaaaacgaaggaatcgaggatctatagagcgaagaagtttttccgattgaagaagagaagaatctggatgaggatgacactagtgtacttaacattgtttttgtgtcttgtgaggaaagaaattcttcagagtcaaccccaaacgacacaaaaacgacgacgtatctgtgagtgtgaatctgggcccggtatatttttaaaaatatatgggccattaggcccaaataatcaagtccttttttgtatttgtatttgtatttgcgacgacgataatacgtaaatagtagtttggtaatatccaaaaagccagcatcgcctctgctacggcgttgtctcttttctcccaattattagcttatatcaatataagaaattattttttttgtggattttgtaaccatgacaggaccagcttgattttgtttttgtaagattcgtggtttctcgatttcatgaaaatgactcaatgatttcgtcctttctatagtattttgggttttaaagtcaactagttgacttcaaaacccaaacttaacgtccatatatatacacatacacagtactgtattatgtgtatatatatggacgttaagtttttgaaaataagagatatatagggcttacgaagccaatatctagataagtgatatcggaacaaaaatcaatcacaaaatatctaccaagagatgtcatatgtgatacgtattaactttatatacatatgattagttccatgaatttgaatttaaaaggtatagtgcatgtatcaaagggcatatatagccacatctcaattgggataaatgaaagagttcatcacgtttcttttcaattcccaaaatggcgatgcgaggaaataaaggcaagttattgatttcgctttctataataattttaaatttttgttgtataacaatgataaagaaacgttcttcaacaacaacaaaaaaatgttacgtacgtgactttaatttgcgtgacgactactcatcattcaccacaagagcaaacggaataaaaagacaaactttatcgttatcctaatttgaaccaaaccacaaaatagccaccacaaatagacaaagatatacatacagcgagacacatcatgcaaaaatgtatatatgtagcttagtggatcattaataatgtttagagaaacgatcgaatttaatgagacttattttcgttgaaaaagttttgatagggtgtaacttaatatatagtatcagtctagtgctaaacatctataagttcaaattccaatttctgtgtatattttggcctccattctacaaatctatatttatttaccacaatgtataatctagacatacaatacgttttacaaaaaaataatatgtagtacatacaccatttgtgaagtcatgtatctatttgacaaactagtccaatggaatttgactatgactaatttattattgtcctttctcttgtgtatctttttttttcttcctaactaaacactactacacattatgggttgattggtatccaataccgctgtagtatggagtatattgctttgataataatcaatcaaaggatgctactaaaaacgatattttaagttttatgatttttttttctttcgtaccgctactttatatcgtttttaaactatttttgtatctcttaccgttttttctacttgctaaaaaacttatacgattttgtgtggccaatcggtcctatattttatatatacaagcattcatagacgtgacgacgcattattttacttaaccctatataaacatatccaaaaaccgcaagaaagctcacaagaaatctcctcccatggcagattcaagttcttctctccctcctctttgcgagaagatctcatacaaaaactattttctaagagttgtggatctcacgattctaggctttctcttttctcttctcttgtaccgaattctactt

SEQ ID NO: 5330 - DNA, 972 bp, Arabidopsis thaliana
aatgacacgtcagtaactttatgccaatagggtctgacaattatgttagatctctctcaaaaggcgtttcatctaatgacaataatttctatgtaataaatttattgcatgtgttagtgtgttaccatcttcagttgtgtgcaatttattaaaatgagtttgtaatatggtttcagtatcgaatataattggggtattaatgtatcttttgagaaaaacattgaaacgtagcagaactaatcattgaaaactggtagctcactactaaaaattgatctaatatgataaatcggttaatgatctggcacatacagtgatcaaatcagctaagcctcatatcttaccatgttaatcaattgtcataagcatgtatttcttcgatttgtttttatccgatgcaaatttttgctttgtgattgttattgcagaaacaaggacgttcgatgcacttccaaaaaacatataatgttacagacaatgtagtattaaaaagtagtagttaaaagcaaaatctttaataatttagacaaatgtagcgacagctccacttaccatccaaacgaatacttcacaattgataattctaataaatgtttttttttaaaaaagacagcatttaacaataacgagaaaacaaatactaacgaattggaaccagaaaccaacgaaccaaggaaaatcaaaggaggcgactcactggaaaggaaaaggtgagatggcaaagtcaacgatccgcgtagaaaccgcgtgaacgtgtgatccatctcttctcatgtcaacctggcgcttaaatttaaaactcaaatttatggcattctcgtaatttcatccccaaaccgaggtccttcccgacattaacaataatccaggtaaataaaacgcctcaagtccgcattcgtagcacacgaatcgtctcacaaactctttcgtttttccctttttctccaatcacagaaaagaaaagaaaaaaca

SEQ ID NO: 5331 - DNA, 2000 bp, Arabidopsis thaliana
ttgttttggtggacatacatcgtcgtctctactctattgtctcgatcgcaagtaatatgacaaataaagcagcagccctagcaataaaacatgtgactactaaaataggaggatttatctttacttgacgaactataaattaaatatctactcttttaccttgactttgaaaattactttttaagattgccttttacaattatgtggaatagcggcacacatttacgtaaatttaacttcaatttaaaacaatgatttattcattttcatcatacaaacttttcagcacattttctcctttttaatataattttatatattatagatagagatatagatcaaacaatgtatgactttaaacttagattgtaaattcttcttactatgctcgaaaatttcatctacgtatatagatctattgtaaacctaagtttaaaacggaaatcagttattgatagtaatctagtaagtttaatcaactatgcgttataacataatgaaatcatatatacgagcttagatatctaattcagttaatcaacaagtcaactaaacaaggcttcacttttccacacctctacagatcgaaattattatatattcgaattatgtaactaatgtaagtcttgcaacgtgtggatagatacaaaatggatatgtccataggtatacatattaaaaatataactagaaatggtatattactaacaaaattttacccccaaaggtggccatccactagtagccacatgcttatctagtagacattgaacatgataaaaagtgccaaataagtggaataatcaatgggaatcttcattcctataaacaaaaacattttcaagcctatgacatagctagctactctacaacatgtatatgccaattgggatataaatgtattaaagcataaccattaatttgacaaatagaaataaatagttcagaatgtataagttgagaaaagttataatgattggtagggagagactcaaaaagaaaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 5332 - DNA, 1302 bp, Arabidopsis thaliana
agaaccgacggaagagagaatcgtctctggtggtagttaagccggagactggagtggtgtgagtctgtgagttgctgtttcgggaaacgagtggttgtccgttaccggagataagtaatgtctacgttacagttttggcggcctttgattcaataactgccatgtggcacgatcctcttggcaatactagttgtgtcggatgttagttttgttggacaaaggaccttcattgaagcagaatgggcccggtttaaatccaaagcccaaacaaaacccattagggtttcattgaagcagaatgggcccagtttaaatcgaaaacccaaataaagcccaaaaaataaatctaatattaatatgggatgatatataccgggtgaaatcataaaatttaacaataaaaatacaaatacacaattttaaaagctaaccaaaactaacaatattaacaaaataaatataatttcaaatttcaaatcttttaattataaaatcatcccgaattgtatcatacattaaataatcaataacatatatctatagttgctcaatacctccggggattactctactacataagtcgtcttgattgaatagatttcctgatgtctagttttcctactgtggaaatcctatttagagtagactcacttcaatgaaagctattacttctttattaatgactattaactattataagatattaagacaaaaagaataataaatctaacaaggggattatgatacatctagttgtagttgatatcttaaaaacaaaaaattcatgtatttgataaaaatataagcccgcgatatatcttttaatatatatcctataaatataatattaactgaaataatttttttaactttctaataaaaatatcaaccttcagtctcttcatgttccctcaaggcaaaattaccttcaagtctctatttttactacatgtggaacaatcaaatcaaggaagagtcggtaggtgatggagattcgctttaaatgtctacgtaacagttttggtggcctttgatttaactactgtaacaatttgtccggacgaaagactattgggcacagtttaaatttcaggcccaaagaagcccactagtatccggttgagagacacgtggcaacagtcaactttgaagaaaaataatgaacaatcattgacatttttttttgtttctcctgatccagttcttaattgaacaaactccaacagcatcatcatcatcatcatccttcaaattatttttcctattttgaaaaatttatttgaaatctcataatttacgtta

SEQ ID NO: 5333 - DNA, 2000 bp, Arabidopsis thaliana
gaatcgacctattattagaacttggatgcatatggatcatgatttatgtcacaaaagttttgtgatatttaatcataatctaaacattttctatgtcttctactatattttgacacttgtgtgtaagacataaatggtaagaggaaatattattgatagtgtttttttttttttggatttgggtcaaaaatattgtggggggaagccacgtgtacaaataaaagtaaaatttagttaagacaataaatatgagagttaatgtatgtatcttagaaacaaaaaaaaaatattaagtatgaaatataaggaaagatatagcaaaaaaagtaagaataaatcaacatcttattatataaaatatggttttcaaagttattaactcataagattatgccacgtgtcaagtctatcgatcagatgttgccatgtgtaagaaaataattaaccattttcttcttaaagaaatagaaatactaaaaaataaattaattaacttttttcttcttaaagaaatagaaaactaaaaaataaatcattattaacatatactaattcatatttctatatctaaaaaatattacattttatttttcttaaccaaaagaaaaattaacaaaaaaaaatcttattatataaagtatggttttcaaagttactaactcataagattatgccacgtgtcaagtctatcgatcagatgttgccatgtgtaagaaaataattaactttttttttcttaaagaaatagaaaactaaaaaaagaaatcattattaacatatactaattcatatttctatatctaaaaaatattacattttatttttcttaaccaaaaggaaaattaacaaaaaaaatatatatatatgttattggtcaaatttttaatatatatggtattaacaaatgttttattattatgaattatgttttgttaattgttaataatttttaatattaactaagatatagatttgatcttatatatatatattattttgacatgaaatcattatcaagtaagatgaagtgtgtaaaattaaaatcgagttttttatgaaatagatagttaaattgtattacaaaattgaatgtataagataaaattttattttttcttctaaatactaaattacaataaagaaaaagtgtgtaggttactatttagacttcaaatatcatcaataagattgaatgggtataacaaaataaaatgcataagactactattttactattcaaaattatatatcaagaacaatgtatcgattattattttactattcaaaatttaaatattatcgataaaaattacatttacatcttatacccgcttatttaggcgggctttatctagtaagaaataaaatatagataaccaagatatattgtaacaacgttacatgtcacgcatccatacagacagagacactatacgttacgaatttcaaatgtaacaacgagtatttcatttttcttctatattcgatctcaattattagattcttttttgtagtaaatataaaaacaatgatttcgattgagacaaaactacaagtgaggctgatgtgaacggggaaaaatagtgacggcttatatctgaattacgttgtgaacacgtttgtttatttcatggattgctaaactttgaggatatagcaaagaagctttaagtaaagcaaacgaatcattaatattttgggaggatgtatatatatatttgaagttgttgttgttgttgtttaaaactgttttttttttcttgtaattaaggttgaaacagattttgaaaggacgttagcacgaaactcgtaaataacgcatgtttattttccaaataaatttataataaaactattatacatcaaaacccattaattcatcatagtggcaaccaagtgtatatagcaatataaatcaattttttaaaaacaacttctgtaaacaaaaggaaagtgaaggcactatgtgtccccacacggttccattgagacaaaggcat

SEQ ID NO: 5334 - DNA, 1035 bp, Arabidopsis thaliana
gatcacctttttacttgagctattgaagtttgcttatgttgaagctgttggtttactatacctggtgcaatccatgaaagaacacactaaaccggttgtcttgtacattgggtcttaaccgagaatcaagcggtttttgtcttgtacatttgcttacacttggcttgtgtaaaaaagaaaaaaagtttatgtcaatgtatctctctaaaccggtttaagacggtacaaactttttgaaagatgccaaaacaaaacggtggttaataattttaccacagagaatatttagcaaaaagatgatgactagatgccacgtccgcatgggggtatatattgtaattagtcgtaactctgggggtaatttagttaaagattgatccgtttatggaaccaaaaatcaaataatttcgtctttgatacttgcttgcgccttataggctacaggagcgagagcaatgaaagcgagaggaagaatctatcaataatttctgggtttaagctgatctctggatcttcctcaattttactttttcagctcagaaaattttgggacttttttttgctgcattttttggttccgaattttctcctccgccttttttaatttttggtaagtttcgatatctctcaattttcttatttcggaaataaaaaaaattctcgcccttttgcaaatcaatggattgatcttgaaatcgtcatttctgaatcgggtacgagagatccagtaatcctctgcgattgaattattattagggttcatattccgaattggggatagtctgaaaattgctattttaagctctcttcttagtgttggttggtttattctggataataaaagggatcctaattctcgctaaattctcatgttcaaacgagtagatgagtttaatttagtttcttcaacgatcgatcacagaatcttcaaaagtgtaaaaattacttgctttttgttcctattactcttttgcagtttgttttgtgtgttgtgtactagtagatctaatatctctctctctttttttgtagaga

SEQ ID NO: 5335 - DNA, 614 bp, Arabidopsis thaliana
cccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaa

SEQ ID NO: 5336 - DNA, 2000 bp, Arabidopsis thaliana
atgatatttgtttttggcaagttttctttcccacttgtaagatcggaacaaaccagtcaatgacataacgaaagtcatataaactcgtaagatcggaagtcggaacacaccaattatatatataacgaaagaatgtagtaaacagacagtgacatgaatatatctcacataatcaattcagaaataatatataactttgacccaattggtcctctaggtagactgcagtgacgtacctatgagccacgataagaagccaagccatgttcctctgctgagctctctgaagaatactcaactagctttttccgtagctcaatatgttcatggcgaagttgtgcaagaggcaaataggaggaggctcactggtctccgtcacagagctggacatccatctccggttgtaactagagattccaaccaaaacagttgtgctatgtgactaatctctgtttattgtagactcttgctctattgtcgtggcatgcaagtttttcatactaaataatcctagcgtaaaacatagaaactagtttgagtgttggtttccccggacataactccatcaagacatggtctgccgtatgatagtgcattcctaacatggatggtaattggagaagaaattcacacaatccagtccaggaatcacctcaccaaaaaagttagcagactcttctctagaaactttccgcatcaaacaaaacaattgtttgggagtactttatgcttcatgccaaatatccactttaagaaaaaatgaatcagataacacaaacaacgaagaaagtagaccaaaggaaaaaataattgttaccttgtcaaagaaaagaacatacccttgtaccacataatgtgcaagatcagatgcattcaaggagctagagggatttccgcatattcatgatatgcaacctaacgagcctcccctgagttaaccattgactcactcggccccttagacattgtttgaagctcttcttcaacataaggtggccaaactaaagatgaagacttagtcacaagaggcaaatactgaaaaggtgacataagatcttgccctcttcttctccattgcttattattgccttccctattttcttgaaaaatatttaaaacgcaggataaaaaaaagtctgcaaacaaatcgacattagcttgaagagaaagaaactcattttatttgtttcccaaagtcaaacaagagaacacgttcatttactctgccaggtagtggaaaacaacgtgtagtcggtatgctctggttagaaaacggcacgtagtttcttcgaacttgaaccgaataaatataccggcttatgccggattgaaatgtggttttagtatatctttctggtttaataatggcttccttgtgattttgattgacaagggaaactctgtagagaaaagaaaaaatctcgacttcgcaaattgcgagagacattgagtccaagaccgagttaactcgccagattcaatgtaaagttttacttttgtcgcctaatttgtgttatttaggttattctgttgaaaaccctatatatagattcgtgtattctgttttccacatcttgcatcttcgttgattcgtggtttaacaatttggatgcagaaccatggctggggttatgcagaagttccttattgcatcaatgtttatgtggattcttcctattgcaatattatatggattcaacaatgatttgcttcctggtaaggctaaaatttccaggtttgacttatgtatgaggacatctgtgtcattgctctaattgtattgatggttctaactttgagttttgcttaatcgtgtaaactctgtagttgaagttttagtggaacttggtttagtagaatagctggttgttgggatctgatggcagattagagaaattctgattgtaactttttagaaactgcaaacttctttgattagaacttagtttgtaggtatcatagaaactagttggagctggaatgctacaagaggttattct

SEQ ID NO: 5337 - DNA, 1237 bp, Arabidopsis thaliana
tgagaggagatatttgcttagcaagtggaatggtctctttcaaatactctcttatcttttatttttttctacaacacacataagtagttcaaaatcgaatggtataatattagtgattagtaaccgaacttcgggatttaaaaattgttctttgtttacttcaacctacaaatttttaaattcagacgaaaagatatttctatttgtagcattttttattaatttttgtcaacgtattttctagtaataatgggaggattttgccgaccatcaatattgtttttttttcttttcttttgatttttgtggatgttaataataatcagccgaaccaaaactccaacgtagtagataagatcagaacagaataagataagcccaaatgtctgcgtccaagtgtactttgagagtgggaaaaagttaaaagaattcttatgtgtgttcgcatttagtcttctttatctcaacgtgtgcaaaaagttttgcatcgccatacaatacataactctctttttttttcatacaaatacaatacatacttaaacattgtgaatgactataataaatttttgtatctcttagaaaatttgaaaataattaattgtttaaatacatataacgtatactatatttagaatgttatactaaacaaaagataggtgacaaaaaaaaatacagcgaatgcgttgacctgtgtgatctcgtaaccatacaaaacttttttttgtatatatccgttgttccagctttcacaatttcttaagtaaaatcagtctttgtgtttctaaatacgttgttcaactaaccactaagataattcgaaatccaagtattttaaaagtaataaacagtcaaaattcaaagtgacaactatagtatttatctgaacagccaaatcaaaccacagcacaaagaaaagtcaaaaacatttggtcaaagcttcaatgttgggaaattgttattacagcttacattattattagtaaaataatgattatatattaccgaagagaattaaaacaaattaaggaacaaaggaacagaataaagggtaaccttgtaaattctaccttttaaagttgaactctttctcttctcattcatttgttctttcttcagagaaaaacaaaaaacagagcattttttttggtcaagagcaagaaaaaacagagcatacttttgcaaaaagcagagcttggagcgctttcttgtcatctaaaattcaaaggcagagacg

SEQ ID NO: 5338 - DNA, 919 bp, Arabidopsis thaliana
cttcaccattaggccattgtaaaaaaaaaaaaaacacttcaccatgagggttaattttcaacaagaatgatatgaattaatgcatcttgctcaagctgaagcaagagagaataatgtaatgaatccttcttaatatttacttttttatctacaattagcgcgcgcacacactatataacctatttgaatcttggttatgattggtcacttcttggattcatatatttttgctataaaagtatacacaaacgtagtatacattatacattttatccatatatacgaatgtcttaatcatacaatcgtgtggaagtaatggtggttcatattactatatcgctttaagtaaataaatctcgttttcaatgtaattggaacatattgctatgtgttagattacgacattatgaggtaactatttgggtactattttaatattttttcatctcctctctcgccgacgccaagatatgtgaagactgaagacagttgctctcacaacccctatcatcagccacgtgtttttttctcctttttattcaacattttctccttttaatttctcaacaaataccatcttttagaaagaaaaaaacaagtcaatatatatttttattatttatatgtatgtgtttaaattaatttgctttcacacaattttactaatataactgacttttaatacaaaaatggtttaggtatttaaaacaaatttcagtaatagtctagtgaaagaactaaaccgtaagcttaaattaaccattcattttgtgaaactgttgaaaattgaaatcctaaaattgtctgggagaacatatcgactctttttgacaactaaactataaatatcatcaatctagtagaggtaagtttaccagtcttctccaaaacaatttgtaaaaatagagtaactaaaacg

SEQ ID NO: 5339 - DNA, 1576 bp, Arabidopsis thaliana
tgttttttcgagctaaccgagccagagcctacgaaagtatccatccatctttgaacatgttcttgtttcttttaccaaagtatccccgcgtttttaattgtaatctagtgctagtttgagaagtgaagggtagtatagtaaattagaaaaaagttctaatcccaaatggccaaatctcatcctcaacaacgcaaggacaaacgccgttttatgatgggcttttcgggagagacaaatgggcttttaggcaaaccattaatttgaaaggattatctaacgggccatattgttaaaaaaagtgcaacaccaaattttgtaatgttgtccatatccaaattggtgacgaaaattctgagaggaacagtaacaaaatctttgacaaacaaaaaaagaggtacagtaacaaaatagtttttctggacaaatattcccatgcgcacgcacttgtcacatcatgcactgttctttgtgcgtcctatgtattgctccatgcactttcatacaagaaaaataataacttgtcatcactgacatgtttttcaacaaaatggcgtttctattgaacctagtttctctaaattacatatgtattgtagaagaaagaattcaaaaacagaaaacagattctttgcatcggcttgtacggcaggagaccgacaaggaacaagcacagccccactccccttctcttcatacgtttcgtgacacccacttcaccatttttttttgtttttttttgaatttttaaccacttcaccatttcttctcgctttggtcaattttttttatggaattcttaacctacaaagttggtatttaaaaaaaaaaaaaactattaactcatatattactttttgatatacccctattaactcatatatgtaacatgtaaaattatactatttcatactacgctaggactatctagaccagtattttgctaatcacacattcaaattatatgcgagtaactttatcttcttcttttttggtaacatatgcgagtagcttaccactatcacaatacttaacttacaccgtcattggaatcgaatctcgtagtataatattagtcattggattatagaatacacatacaagcacaatgaaattcgatagtttccaatcgttaaattattttcatacggatttaaacacatattagttgaacagaagaaaagacaaagatttgaactccatactaataataaccaataagcattgaagcagaagcaacaaaaataactagcaatatagtaagggtcctatcaatatcatttgtcttgttttgttgtgttgtcacgattcaccaagtccctatcacttggaatcgcgattaacaacatcgtccatatctcttttatatatatcttccgacgtcaacatcgttaatcgcatctaaatttagttatttaaaaaatcatcagcagaacaatattttagtggtcgggcttttttatttattcagcgatatctgaatctgatcctggacggtgtgcaacgtctttttccgatttaaaatcatttttttgcattagtgcgatttaattgtgtttctaaaacctatcacacaaaa

SEQ ID NO: 5340 - DNA, 2000 bp, Arabidopsis thaliana
tcgcttaaaatggattaagtgttatttatttgtatatttgtatgatgcatttacatgcagatatgaaatgtttctcgatttaattcatattatctagatgtacaatagtaaatggatgcatttttgaaaaggaaatgaattttggtgcataattgacttaaaaagaaagaaaaacatagacacacaatcccacatgcatgcatatctcattttcgtctccttttatcgtttgatgttaccgaaccaacgtatttttgttccatgcaaattgcaattagagattgcggaatgagggaataagaaataacaaaattacatatatgtgatatgccactactgagtttaattttgctagttctcttttaacaaaagactgatcatttaatttccgttgagtttagttcatatttctaaaataaaattttatctttataaaaggaaaacagaagagaaactaggagaaaataacaaatgtaaactaagagaagtagagaatgaccatataccatatgacattatataatcatttggaccacgtgaaatgacatttctcttttcttaattatcttcagaaattgattttggacccctctctcttcgacttccaaaatcattttttatgatgaatgacttccaaaacattactagagctatctattcctcaatcttcatcatttttcctttgatcacatcagatcatagtaattaaactgcatcagataaaccgaattaatttcaccattccaattaagataacacaaatgttcgagaaataatataaacaacatacagtgagaatatgtcatttttataagaaagaaagcgtgtgtttttggcatgaaacatgtgaatgactcagtttttattgatatgtttcctagtggctatctttctctaaactatttttttccaactcactctcgtttaattacttaaaacaatgtgacgatccttgtagaaacctttttgacccttaatcaaattttctcaaaactcaatctttttgtgattaggtcgaaccattataaccgcatgaatatttagtggacaattcggatacgatgtgtcacggttgaattggccatcgaaaaatcaccctcagcactatctgacaaattacctcagaaattggtttggattcattgcgaaactcttcaatgtcatagttgactgagtcatagttaataatgtattttagaacatgagaaaaagattagaccaaaaaaaaaaaaaaaacatgagaaaaagatgcacaatctttctctaaaatcttacttttcacgtctcacacaaaacatttctcattacatttgattcaaaatttttatttattattaccgtagttgatgattcatagggtttaaacgcaacgagttcaattgtgagaatatggagaagtggacggttgcgaacttgccgtagactatcaagtgttttgaatgattagtaaaacataaataattattaaaattgagagattaaagtgtttgacaattaacatgaatatatatatatatatatatatgaattttattttgctcacgtgatttttttttactcggggaataaaccttaacaatctcaaagtaatttgaaacaatataaaacgttttttaaatgattgattttaaaccaaaatctgcaggagaaccaataagttgtatagttattgataaacgaattgggtggatacaataaatacctggagattctttttcattaattaaaaatatatatacaaaaaattgactaaaaatattttattttaaaaaaataaaaattgagggccctataaataagagatatccactcccactgaaacctcaaatcaatcagagagagagcttctgagacataaacatcaattcaaatcgacgcaagcaaagaaagcaaaatgtaagtcactgaagagtttggaattcccatttctgttcaattttcaattgagtttttgtgtttttctcttcagggaaaatggaagcgggaaggtgttgaagccg

SEQ ID NO: 5341 - DNA, 1290 bp, Arabidopsis thaliana
tcaagatttgatgtctcatcttctgaagagcctcgtaagccatgctggcgaacagttagggaaaaacttagttgaacttcttctacaaggaggaggatctcaaggttccttaaatattggaaactcggctttgcttgggattgagcaagctcctcaagaggagttaaagcaattttcggctcggcaagatgggacagctaccgagaacagatcagaaaaacaagtcaaaatgaatgattttgatttgaatgatatctatatagactcagatgacacagacgtcgaaagatctcctcctccaacgaatccagcgaccagttctcttgattatccttcatggatacatcagtctagtccgcctcagacaagtaggaattcagattcagcatctgaccagtcaccctcaagttctagtgaagatgctcaggtatgtatattcttacctcatccattccattattttctggatctcttagcctgctgatattttcctgtgaccttttcgtaatttgttatgattccatctcagatgcgcacaggccggattgtgttcaaactatttgggaaagagccaaatgaatttcctattgtcttacgaggacaggtattggtctgcttgattattctcaagttcttactttgtgatgttggaagttaaactgatgtgctagtttctcgatatacagattcttgactggttatcgcatagtccaactgacatggagagctacataagacctggctgtatcgtattgaccatctatcttcgtcaagctgaaactgcttgggaagaagtaagctaaacttcctctcccctctttgacaatactcgtctttataaagttccagactcctcaagggtttttattttgcttggcagctttcagacgatctgggttttagcttagggaagcttctagatctctccgatgatcccttgtggacaactggatggatttatgttagggtgcagaaccaacttgcatttgtatataacggttagttttgagaatactttcaccttgtgaatacctctctggatttctcagtatttatcgtcaatccggggttgcaggtcaggttgtcgttgacacttcattgtctctaaaaagtcgtgattatagtcacatcattagcgttaaaccgcttgctatagctgcaacggagaaggctcaatttacagttaaaggcatgaatctccgtcagcgtggcacaaggttttgttccgtttttctttttaatgaaattttggccttccttgtcttaattttcttcttctttgatgtctaa

SEQ ID NO: 5342 - DNA, 2000 bp, Arabidopsis thaliana
aatgttcggtaacaaacacctatcatcatgagtttcccataagttgatcaagtctcttttgatccgcatccacgtggtccaacacatcaattggttccttcgtattttgtattttatatcgtgattttttgagtttttataggctaatataaatactcatttatttgtggatagtttgaactgtttatagtgattagtgaacgattattattgaaaagaatcataattaaaatgttagaatttttaaatacgtatcaaggtaattgatagatgaacttttagtaaagtcatgtttcagtggattttagtttattttatttgtctaaacatatcattaatatatcatatatttggttaagacaaagatcaaattattaacaagtgttgagattaaatatttatgtgatgttagactccaccaacaaagaaatagtaatctattatcatcaaccaactccagttacaataaacatatactctaggaaaaaaatatgtgttgtattgtgattcgtaatcaaaaatataataacttgggtggttctagtggttggttagaccatcatctgtatgtatacgtacacctgtggcctgtatatatattgaaccatgcatgactaaacgatataatttttataaactatatcatctagacgaagtttctgattgaagaaaaagattccatgacaacaaacacgttatctagattcgttctacatttccaaacaaaattaacgtgtgggaaaaccatcagatatatctaattgttttactaaaaccgtccaagatacaaaagctttaatatgtcatggtttcgaaatatgcattgacgtataataaacatgaaacaaaaaatggtcttaaatatagttattgctaaagaataactaaattcaacaagtgttataaaagaagaagcgagagggacaagccaacaaattcttcttttgtgcgtgtgtttgaaatgtcctatttaggaactacaaagttatgccattaatactttttgtaaatgattaaattttagattctctattgattttgaaagtctataattttcttacaaattgttatttgttcataaatggagatgcatttaaacataaatgttaaccagattggaagtaaatagaaaaaaaattcttaataaatagttttctttttgttagatggaatatctattattttttaaaaaaaaacaatgaacactttcgtgagattaataaataaaaagtaatgaatgtgacatagatccaagcaacagtaactgcatcgatggtcgaccacaaatgtttctttacttaccattctttaagaaactactttatttgttgctcatttttaaaagaaaatatcaaaaataacaaaattgtttccttcaacaaaacgcttctcaagattctcgtgctttgtgtttcaaatggagttactataacaactgataacatatttgattatcattcatttctcagtactaaggaataatatattacatagtcaaattcatattgaaatactaaggaataatcaaatcacaatacattgtaggaacaataatcattctttttataaacaacacgaataaataatattcaaataagaacaaactataggagaacgctatcaatgaagattaaatttagacgaataatcaaatgttgacaaaagaacaaaagctgaacaatcaaatgatataactagtgagcagtgacacgtacactttgggtttactatacttcatggaaagataattagttctaaattgactatattacccttccataacaacacgcgaagagcttaaaactaaaaaccaaaaggaacacacgcatcaactaggggtaatatagatattttctaagacgacgggtcaactaccaatccatataaaccgattactaccaattagccagtaacaaaagaaaaacataaaaggaaaggcaaaaagaagatgtgagcttgtgaatgccaaaagatcacataactttctctctgtttcatca

SEQ ID NO: 5343 - DNA, 1280 bp, Arabidopsis thaliana
attgtaagacactgtgataagaccagagttttttataataagaagtaagaatctctttttcacattctcagctatcagtttattcgcactaatgacacaaaaccttgagcttctgtgtctaatcctaacaaatgttaatcattttcactttcaagtcttcttcacattatttattccaaaagctttgtgtaaatatcaatttagctgatctgatattcaaagaaaataacaatgttgcttagctgctactttaaaattatagctttccgttgcatttcttggtacacaagaaaacgagtaagacatggtttttaattaaataaattaatattgaaatggatgtctaagtttatgggaatgcatttaattagaggcacatgatcctcctctttgggattgctcaccttgtaaacatctctttatgcttttttgaaaataattatttttcattgatgtgaaagaaaagaattttaaaagccaatatctcactcgttacaaaaaggtaggacaaaaagaacccaaattgtaggttatggtccaacaagatcggtattaggtgaaactaaagtgaaaatatatgaacggacaagccatgaaatgtcaaactaaatcggcttaccaattaaaaccaacccaatcaactaattatttgtgatgagtattttatttggttatcgtttataaaggacttgcaaatccccactttctatgaaaagttcctccctgcagagacgatgtttgtctacacgtctccatgtgaaatacatgactaactaaattacggtgcaagcaagcaatatctagcttttaattagtcaaagctaagaaatatccctatcataaaagtatcaaattatgaaacctgtaaaatgaacagagaagtatactattttgacaatgactacataacgatacaaatgaataaaataaacacgagataactttcaagatgagatatgtatacaagatgccaatgaatcagaaacagaataatgtgtaagaaactagagagtagtcaaaatactcgatccacaagtaagctaatttgactatatgcattattaatcaacagtttaattatatacatattatatacaccacatatatgatacctaaaaatggcataagttgacaacgaccctcgtttgccaaattatagtataaaatcatcagggtgttaaatgagagattcccaataaactcaagaaggaacaaagcactctctttctttgaagatgatgatcacaaaaaaactatatcaatgtatgtgtttattatgc

SEQ ID NO: 5344 - DNA, 424 bp, Arabidopsis thaliana
ggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgaca

SEQ ID NO: 5345 - DNA, 2000 bp, Arabidopsis thaliana
agagaataaatttatgaactatacattttgttattggatcaaaggataatttcttacaacatctcacacacatacatatagtggtttctctacttgccatacacttgcatccatacttctactaacctagaccttacttctagacataattatcccatggttcacttacacaagcaacctaacaactacaacaattattatacttattctttagctatgctttagactaacaaaacatcactatttcttctttgggcctaacttaactaatagctcaacgctaaaaatattacaaaacacacaaagcccaactccttcttcttgttgacttttggcctttatttttgtgtcgttggcttctattcaggacatcattttttttttgataaaaggtgaaattttataccatttttgatttgtgacagagattacacggaacactagaaacggaataaagcaacctacaaaacttaaaaacaacatcactgcttccattgcttctcttcacggtatcttcttcttcttcgcttctgcttcttctcttttcttcatctacttcgaaacaacaacaaaaacatgtcgtgcataacaaaatctctgaactaaatatttctacacaaaaaataaatatttttttttgaatttaatgttaaattatattcaaagacaaataaactgtttatacataaaaatgcaaacttttcttaaattgaattaaaagtgtatcctatctatccttgattttgatcttgcattgaagcaaaccacacatggattcctcttgtgtacttctcttcacctctcacccttagcatgcttaatcgattccttatgtttttgtctattagcctgattagcttctccgtcatcgatggagtctctcctttctcctctcatttctttctctccagataaaaaaataaacattctattctctaatatcgtcaaaacttcatacgactatccttaaatcaatactttcgagtttggtttgttaaaaatgatggttttgttaaaaacaacaacaaaaacatgatgtaatattataaatctaaaagatcaataatattactaagatacattttataggctgattaaaacgatgaaaattgacaaattcatgcaaaagtttaaaactttaacatcatataagagaagaacaaaacaaatgatgtttacacttaacatgattttgtgatttttaaatcgacattaacttttttgaaactttgttgtttgttttttaataattaccatgttattttactgtatatgtatatctaaagaaaatctgtaacgcttttaaacaaacaaaaatggagaatatcaattcaatgacatatgtttactttactgtagaggaatctttaaattatagccgaataatttagttaagagatcttttcataaaattaattactagcttgaaggaggtttcataaaattaattacatgaagaaggcgtttaaaataaatatgccaattatattaaaatcccattataaaaaattattattctcatcttttattcctctacatatataaaaaaaataacctttctctttctcattacaattaggagaatataatttgacaaattaaccactttgactaagcaacttcaacactttcgccatcctaatccacatggtcataactcataagtcataaaccttttagtggaactagattttctccatgacatcttactggattagatcaaagatatttttaaggaacaaatcattaatttatattataaatcaaaggagaaaaataaagaataaggaaaatgcatagaaatgccactaaccatccacttctatggctatttccgcgaatcaatgcaaagtcattcatttattcccaacttgccccatatgttttctttttcttaatcacagattcttcttttttatttttaatccatagaacaaaaaaaatataacctttaaattttctctcatttcttcatcttcctctccacaaaacccatttta

SEQ ID NO: 5346 - DNA, 1833 bp, Arabidopsis thaliana
agataataagattcaaaaggacttttttgagacacgaagggaatagtttttgctttctgagatcatatgaatgacacagaagaattgtgcttgtttccttttgatttcatgaaagcaaaaaagaaagaaaaaaaataagcagaatctgtgattatgttcatgagataaaactttcaaaactatgttcttgattaactattttggcttatcttctactttctttttttgtttagattcttgcaatgttggttttctatttcttctaagaatccaagtaactaatctgtcattattttcacgagtaatctccaatggcttcaatgttcagtttctttaaatatccgcactcctctgttttcatactcttagcagcaatactctcaacagggtgaatcttggagaacagatatttctttcgatctttaatgtcatgactcgtatgatgttgggtgcaattgttgaagaagaagaaagaacaattcttggaaacgagctcaagaaactgattctgttattccagatatcgaaggaagctcaaaaatactcgtatggttttcgcgcggtttgatttccaaagactaactaaggaaatgcgagttcatgtcgaaaacttgatcttttagtcgatcaggtgatggagaatcatgtgaaaatggttggcaaaaagagtgatgaaggaagaagaagattttcttcagtatttgttgagagttatagatgatgatgagaaagctccattatcaatgactcatatcaagtcattgcttatggatatggttcttggtgggttcgatacatcggttaaagagcctcatattcctaggttactttacttgcaagctataatgaaagagacgctacctttatcttacagttcctcaccggaatagtaaaacctcggttgttgcgggatacacggttctgaaagatttaaagattttcatcaatgtttgggcgattaatagagatactaagaattgggaggaagaaggatccaaaagagtttaagcctaagaggtttcttaatagttcttgtgatttcattgataagtgttgttgtgttaaggttttgtaaggaacattacttcctcgttctttgattattattttcatagaatacagcttttatgtggatgtgatttgtgtgcggttaaaaattcataaaacccgatttaattgttgaaactttaaaaacatattttaaattttcaatttttttttaacataatatatacatacgattacaacaaacgaacttaaatttgtaagaaaaacatatattgattaactcgtgtattgtacgggttctaatttagtaattatataatcttgttatagtggagcaagtaacatttgacattacataattgataatgaaattttcatttgataatcattgtacaagtttttttttcaattaataaagtgtgttaagcgatttgaactttgaattagtatcttagtttaaatactttaactcgttttctaaggttaaaaatccaaattttagccacatttgattatcaaacaatctaaccatccacatgttatcatctgcaatagtcagtcatataaagatttcttttctttctaatcatttaaagataatatattataagtaaatgatgaggtataccgttgacaaattattagatttaatgtgaaaagtatataatctttgatgacaaaataaaattataaaacttatcaatctagcatctatataacctctccttcatgtcaaaatttgatacaaagagaaaaacattggaacaattaaaagaaacaaaatttccaaattgattcttgtgttttctacataaacaagaacca

SEQ ID NO: 5347 - DNA, 773 bp, Arabidopsis thaliana
gtaaacagcgatggtaatgagatgacgcaacaacgagatgctgctggtttatataccataccatataatgaaaggggtaacaatgtcatgccgtttcacacctctctcctacctcacaaccaaatagcctcacgattactccgtgtgtgtgtctccactgtccagagctttaatcttcgatcaaactcacaaaaattataacatatcaccggttcctcctagctacaaatattaaacccataataataatattgtggtcagtgattattctcacctactgtgggtatctaaaaacttgcttaaaattctgatgatttgcaataaatttcgcatctttcccgctttaaaaaagcccaaacaaagcccattagaaacccaaaaaggagggattggtttgttattctctgtatctctctcctagtattcagctctaacacatagagaggagtcagaatatcatcagccgcctctttcacttcaaccctccttaaacctcatctctttcctactccgccgctctctccgtcgtctctcccgttactccatttctctcgacccctccaggtaattccttttcagatcctctactagaccctttacttattttagtgaattggtctttctccatttccatctatcccttacgtatctgtgactttttccccccttttggattgtattcctcatcttcctctgtttccgtcaaatgaatgatctttctgaaattcaatcacttttgtatcgtttctgaatctttcctctaataggtgaaa

SEQ ID NO: 5348 - DNA, 837 bp, Arabidopsis thaliana
gatcagtcaaagagataagaagacttgtgaagttagagtacttagaagacgtcaatgatattaaaatcatcctattcttagaataacaggtagacttctgaacaagaacatctcttcttctaggaattaagactaaaatctacttacatccggatgattcatgctctgttttttggtttggtataatttgtcaacacatctagatctgttccatttccggttatcttctattgggttatctctgaaactgttatgggctcggcccataaatttaaaccttggtgtaacaaaaagtaataaaatcagctatttaatcctatatatttgtttctttttttattatataggaagaaatccttgcctttagattgcatacactagaattttagtattttcaaaaaagaacactatatttcaaataaaaatggtatatatgataagttttgttaagatattatattcaataaattgcctaattcaataagcatattttagtaaaaaatcgcaaaatattcatcatctactaaacaggtcaagatgtatttgactatcttaagaaagaaatattaattcactttgaccaaataaatggacaattaggtaaccaaacaaaaaccacatgaaagtaacaagacagagaattaggcaaaccaaataaataactcacacaacccaccgctcaaccacctaccccttgtaatatatctctccccttcttctttttatttcattatcttccaaaatcctcaccacaaaacattatataatttcctcttcatatttcaagaaaactttaatctttttttgtgtgtagaattctatatttctggtaactaa

SEQ ID NO: 5349 - DNA, 2000 bp, Arabidopsis thaliana
acaatcaaaaatttatttcaatcacataagatcttgtcaaaatccaccaaatcatcatgcgtgtttttcaacatctctccaaatcttctaaaaattactaatccaatacaccgcctaactaatgtatttggtaataactcttgatatgtacaactaatttacgtgttctccaccataggttatatctgttaactagttacgtacgtcgaccaaaaacatattactttatcgtggttttatcgttgaattattcactttcatgttgggatatcaagatttgaatctttcaatcatgattttaattatagttgtcaaatgtcatatcaaaaatatctattttcttatagtttttaactgattagtatgagtttcgatttggaatatttcagatatgaacatacaactaaggaacaaaatattgatattagtttcctatatctttttatttattttaaatacaatagcagatcacatgtatatattttaactcaatagttacgtcgaccaaaaacatataactttaaatatcgtggtttcattgttgatttattcactttcaggttgggacatcggaatttgaatttttcaatacgaattttaaacatagttaaatattttcttatagttcttacttcttaacgattagtatgagtttagatttggaatattttaaatatgaacatatagttaaggaacgaaaggcgatcacatgtttgtagttcacctaagtattgtagttataatctcatccagtacctggagcagttgagctaatctttagattaagcttgggcaaaaaatccggactaaaatacttgaaccgaaaccgatccaaaaaatcggtttgggacgagtacggatattacctatttactttattgagtcttgaattgtcgtacccgtgagtatagggtaaaatccaacccgaacctgatactcgaacatgtatccgcttacccgaaattacatatacttattcatagatttatatatataaaatcttattttatatttaatatttgaactaaatacatttatatccaaatatctaaaaataattaccaaaaactaaatacatttgtaaatacttaagactaaatatttttatacgcaagatacttataagttttttggatattgggacaaaatttcggttatgtgggtaaaattcagatatttgggtaaaatattcaggtatttagataaaattttagatatttggctataaaatacctgaatctcaaagatacccatttttttggtatttagcggttctaaaattatatatccgaaccgacccgaaccccattggatccaaaccgaaacaaaacagaaattttagatttatcttattgggtcctaaacttttctacccaaaaaattcttatccgatcgaattttacccgaatattccgacccacatacctgaatgcccaaccgtactttagggaattacatccgatgcacaaaagaactaacaattttgtactatcattaacaccacccatttgcaactccgaaagacgatcacatattgtagatttaaaatgcaatcttaatcacattttcactaaaagttttccttaacgtatttggtgggcatgatttaacagctcaatttggcaggtcaacgaatcaaccgtgctttaaacgttgtaatgtttttcaacttaagataagactcgaaatcaattaaaaaaacaaacaaaaatcatagtcattgtttttctttgttaattcatatacactcatacaaaacattgacaacttatctattgtttaatctaaataatacaattatgtacaagtgttactttagtaatactgccgtccatataacggcacaaaacggagaatgacgtcaccattgttgatgtcacacctccatgtaacttctgttataaacgcattaaacgttacacttgtgtatattatatagatctctgtccctttatatttcatcttttgacattacaaaattacattaccaaacacattaa

SEQ ID NO: 5350 - DNA, 2000 bp, Arabidopsis thaliana
cagctctcacacggtcaaagattcatgcaatttctatcttactcttacctcaaatacaccaaaccagattttgttagatagtgtgatatgaatatcatcaattgtcgctatctgtataatatcgtatcatatctgtctgataacaatcataaactcaaaacattaaatgaaaattagtttatattaatatcataaacacaattagttatcacgtttgcataaaatacactcatatacccccaaaaacctttttattactatttggttaaccgatggaatcatagatcgaacccaaatatattttcgatgagattgaagcctcttccatacaaatttcgaacccaatctttaaaatgcaacttttgaagggcaacaactaccttagatgatataaaacaaaactttcattaaattgctgttttatttattttttcctttcgcagaagggttttaatttccaccacatagcgatttttagtaaccggccacgaacgtaacgttctataaatgtagaagacgttaatttcgtttgtcttttacaataatatacaaatcgtcaatgacgaagttaagtctaaatatgttactatagctcgtccgttacgcatgttgatccgacccggcccatacactttggtttgctattcgtctcatacactgacctgtgcagtgtgcatgtaggccatgtaagaaatgaaactatgtgtgtccttgccacgtggattcactagtctcgagagaggctgcaataaactttgggatttcatgatatcaaattgtttgtggacttcaatgcaaacctctttattcagagatattctctttgatgtgaagcaatcaacattaaccgaataataataactactcgctatgacaatagtctagattacctttccaatatacgtttctcgtcacttatgcaaatccttttgttaattggattattgagatttatggagatctctgttgaaactagtgttttaacttttttactgcaattttaaaacaatataggtttaactgttggcagcaaagacagagagtgttaaatgctaacccattggagacaatatttatcttcggaatgttcgtaccatataagcaaagtttagagatattatttttcgagttttccacaaatttattattttgattgttttcagtgtactatcatttgattgttatgttatggttcaagtttttttttttttttctttttcttattctttgcacattatattataaaatatacgttttcattggtccaaggataatttttgctcacatcaggttacctgttccataaaaacattgtgaaagtcatttttgtttttgttttctaaagtacatattattagaaaattcacacctaatataagtcatggaaacaaatttaaattgatcatatcattagagttttgtggattttataacatattgatatattttaagattttttagtagattttagaagtatcaaaacaatattaataaataagatataattgagatgtcatcctagtttatttaaatttattgctttaaaacttgataattacaaattgaagaaaatttgagtgaaacctataactaatttattgaatgatggtccatcatcttatcttcaccattaattatttttgttcttactcttaaatgtttataaagtgtgcattcactttttagttcatgttcatgtgtaacaacacccttttacacaaacaaaacagaagatcaaattaccaaccaaattcacaaataaggaaacacttttccaaagtacaggcgacaagttgatgatcaaagcctctatttttttaatagggaataagacaagtaatgccacatcatcatctgattcatgaacctcttcctcctctctcttcatcccccactatatataactccttcctctgatccttttctctcatcacactctctcaatcacacacaaaactcttgagagctaacaaaacagagaaccaacgaataaaacaaaa

SEQ ID NO: 5351 - DNA, 2000 bp, Arabidopsis thaliana
aaacaactttgtctgtgtaagtttgcttttcttgaatgtaaaaaacaaaacaccttggatttttaggttggttttacacggtttcgtgttttaatcaaattcatcaaaattttcaatttttgaactatccaaaaacccgaataatccgacataaccgttattgcatgcctagtttgatttgttaaaagttcccgacataaattcttaccgtgggatgtccaaacgacaagaaaacaacgggtgtgacaaatggacaaataaaagcaaaaagcttaggccacttaaaccaaaagccatttcatcaaacgtattctaaaatctaaactataaataatgtaatatcgtcaacgatggaagcctataaacactatagttgatataatcatacgcatctattataagcttgcttacttatggataatttttcttattctctttgacttatttttgcctagtttcattgaccatcataatactttaacaataccgaaagtttcataaacattataaaactttagtcattgtatacaatccgaaagtttcataaacattataaaactttagtcattgtatacaattatcaataagttttgtttcccatgcatgtgaaatatcacttgactcaagatgaatggtcctaacacgtttacctttagagacacatgttaattttcatattgaaaatgaaagtaaaaacaaaatgcttaatatagcatagaagaacattagctatcctactaaattaccatatagaagaaactcatgaatttcacactgtgttcatgagttcatcgagaagatctactaacgacatgtaaactggttattaagtatgagcttgatttctcaagactcatcaacaagtgttccatgtatcgacgttaccaagcgttcgggagatccacaagtaaatggatgctttcttttttaaattgtttgaacttttataaaatcaggtcctttacatgcacttccagaatctgtccaagcgagagatcataagatagaacaaagtgataatatgataatattgcgctagtacacgatttgttgacagtttaaatccaaaaatgttcatcaacatattggtacgattagtaaatgagtaaaaaaaaacttaaataaatcaatgtaaattgggtgatgtatgtagacttaggtattgcactaacttgattttattgattcacaaagtatagtatttatacaagagagacatcttatgagatatactctaatccctaaaatataggacataactctatcacaagatatatagtgataatcttaatgagattatactctatccccaataatgtatcaaaatatataaacgtaaaatgaaaatttcagcttgaaaaatgacaaatgtagaacttttttttttggtggtagattctgtttttaataaaaatatattataaagttttgcaaacttgtttcgtgttgttgttgattaagtgatgtttatggttattacgaattagagttttggtcgttagaaaacagagaatttaaatgttaaaccgtgcacgaaaacaactaattttttcttctaagtaattaaaaaaaaaacagtatacaaaaataaaataaaaagattcaatgaatgataaatatttacgttgaagttttgtctttctttaggttaaattcaattttcacatattcatttctttattattcccttcttcttctttctctttctcttttcttccgcaaatctccgcaaaatcttccctcaaactcagatccgattcttctaattctttgtccccccagagattcttcttctttctccaagtaaaagaaaacaactttctttctcttttcttgcgaaagtcctcaactttcaccactaaatcagcttccttcaatcactgtgtttgctttggacccagtttctgatttagcgactagggttttgattggaaccgtattaagtatatgagaatcgggttttactggtgaatcggattatcatcggaattcggaaaaag

SEQ ID NO: 5352 - DNA, 755 bp, Arabidopsis thaliana
tgagattgtttctttcatttgaacctacattgttccatgcttctttgacttttccaagaaacaaagcctctaataaagcttgcatcaaaaaggattaatatacagtattaggatttaggaagcatgttctgtgatgtccattcacatttcttgaccatttgagatttaaaagaactaagaataaggtaagatatttatggtgtatttattaaccaatacacaaagccggttcgtcatattgaaagttgaaactagttatatatggcccaccatatcaagcggtgaagttctataagtggaaaggaaaattactcttacgaagtccttgtaaaccaagtaaatgaataaggcaatagtacatgtattctaagctctaataaaatggaagtaaagcaatatttctaaattttaattgttaaaaaaagttgaatgtcgcattaaaattatcactcttgtgaaaaaaaaagaataaaagttgaatgtcgcaatgttttttttttgtttttttcctaaacatataaataacaaaatggcatgtgtcatcacaatgtaaaatctcataagaaaaataaggaaaaagaatattcggagccaataagaattttatatttacgtgagagacaagtggcccaattgacgggcccatattgcaaaaacgcctctttttaaaacccgcctcttccttcacaccaaccttcacttttctctcagatctgctttgagattctccgattgcatctcaaaaaatctcagct

SEQ ID NO: 5353 - DNA, 637 bp, Arabidopsis thaliana
gagtcaccgagttagcagtcagctataaaattcttgatgaggccaagacaccttctttgtccaaatgggctgagaatttctgtaatgatcccgctgtaaaacctgtcatgcccgagactgcaaagcttgctgaattcgcaaagaagatctttcctaagccgcaggcctaagttgttggtggactaggttttgtatttgtgggttgggttcttgcaagaataaattaagagtgttattgtttttagatggctttatctttgtgtgtgagttttaatcaggcgtacgttaaacgttacgtatgtatcaggtttggtgaatgattttatttaggttatgttgattgagaagtatttttttttaattattgtatatatctaactcgctaattcctagaagaatcaacaatcacgtgaattggtcctattgccaggatttaatcgtttcattgttggccacacttcaatttctcaccactcgtttacaaggctgtaccacgtgtcgaaatttaattcgtatatcttcattatccgttacctaaaccctctaatggaaacctaccctcttaagctttcatacgatcttcttaacccgcaagcttccctctctcttcgagtcggttcttaatctccgggataaa

SEQ ID NO: 5354 - DNA, 585 bp, Arabidopsis thaliana
ctctgttctgtataattctggttttgcagattgaagaagtatgaggtagaacaatcgttttgaggaccacatattcaaagagatggctttaaggcggcaagagctttgcattcgtttagagatagctaacgatagagatgattcgaagtgagttttgtaatcgatttttaggcctgaatctcatgaatgtgaattgttcataaacattttacaaaatctctgtaaatttttctcttacatctataaaaatgatgtttcagtatcttgtttagagtggagtgtggaatttggaataggcttcgtatgatcttcagactttcggagccatggatataagtatgggtgtttcaaattcgggtacacccaaccggtttaatccaaacttaaaccgtaaaaagccgatcaaaaaaataaacaatgcgcatgggctttgaagttgagaggcccacaatttttgaaggctcagacgtaaacggtgacgtataggaggcaaaacccttgcaattgcagtgtcgtcgtcgttgagtagtcgaagacggagggaaagaaacagagaacttgtttgtttcgtcgaagaataagatg

SEQ ID NO: 5355 - DNA, 2000 bp, Arabidopsis thaliana
ttttaaaagaacttgaaacaaaataaaagaaaaggatcaactgaaaaccaactgtcaatcaagttcatttaaaactcaccttgtttcatacagctgtaatgaaaaataatagtaatggatttcgaagtattttaaagttccaaccgggtattctgcaatgcttggtttgaaatttgaaaaagttgactatggttggtcaatgcattcatgctttgatgacaaaaatcaaaattatatatataaaaaatagttttcttccttcacaattatccactatagggtttatatatactatatactctttaattaattctccgatagttgttccttttgaaaagggttgaattttctgatagtttcgttaacttaatcgtttttcttctatgcattaatttttcgaaaattgaactccaatgcagtacatgactacatcgtattttaatattttcccacagcttctaataatattacaacggggggtttaaattcaaaatttaaaagattttaatcgtcgacatgtgaaaatgtagtattaggagtgtgtttatatatcccatgtacacatcacgagttctcgtatgagtatgtgttggttcttacattaatcaatttatcacgatcacgcattaagaaggcgacacattattatattgtagacattgaatacttgtaacgtcctttttaaaaatatattgacaaatatgtcaccaaacccaaaagcaacctacatatgttgtgtagttgagcaaaactatcattggtgagtttgttcacctataccctaacaatctcaaatctaaaaccctaattactcatccctatactctattgtatcacaaaaataggattctataattttatacacgcacatatactttgtcaaagcgtatcataaaaaaatgaaataaaaatcaacgaaataacgtgatatggctagtaatatagtacgtagtcttacgacaatagtttaacttatacgtgaaaaagtgggataacatgagttttcatatttttgtcatcaaatgatatgaaatagaataaccgaacatagatcattttttcactaattgagaagaagagaattagagactatcgactcgtacgagtggtgaaacccctgtcattttgccgttatacaatctactgaccatgtccatgactaataatacatctatcaacaaccatcatgtcccttgaaccgacaccgaattacaaaaccctaacttaatatcttcaaaacatgcaattaatagacacgagaataagataaaatgaggaggcaacatcccatgcttactttgtgacttcttttacacgattttctaatacattttaaaaatactacttgacatctctccatttttggggggttttgaattaaattgtatatataaatggttcatgcttggacattgaaaacctgtgggtcatttagtcatagatctctctctatcttccttcctcctcctcttactaggctcctcaactaaacgtcttcaatgctctctctctctctctctccattcttttacgacctcatagacttgaaaatttaccattctatttttcaaaacctttatattgatgagattaatatataaagtctccaaccacctagctaccagcctagagcaggaacattaatggtggtgcacaccatctcatgcttcacataccctaaagttcttcactccaagtttatgaggagatctagagagataatcatatagagaaagagagatctccagagaaaatccattgaagggaaaaaaacagtctgtctttcataattgctctttctataaatcttctctcttgtgttcttacctttcttctaaaaccattctctctctctttaacacttcatcactctttacggaaaatttcttattttcaccacctgagccatctctattttcgtcaaaacttctcaacttttgtgccaaaacgtcatttcttctgagggaataaacacaaaagaacaattttcccggaaaatc

SEQ ID NO: 5356 - DNA, 1556 bp, Arabidopsis thaliana
gagttcaagaactttgtaacataaaaccacattatagtttttcatgttcttctattcaattgttttttgttggttatagacgtaaaccgggtcatactcctgagttggcccggacccttcagattaagttttctcgattattgatgtattcttttgacattatagtaccaaatcaagtgctaagagcctaagcatacgtatcatgaaagtttatttttttcgtttttctttatgcttaattgacccattacttcgatttctttttttttgttaaaaggtttcattcactcgatttgtgtatgactaagagcatgaatttgatatgttagaattagaatgaatggttgttgagctaaattcctacttatttccataatcagcttagaacttttgcgatcataataaacaacataatttgttggcgtaatatttgctgagtcaatattgaatgttgaagttataaagaaagaaacttatcctaattccattttgttttaaaacgcattgctatgaattgatgagtattattcttttacgtaacattattgaatttgaacttgagaagatgataacgaaattaattgaaaaagaataagtgaatatgacatcaagaaaaagtggcctgaaattccaaattagttgagcagaaaagtttggggcaaagtgatttccgacgcggattaatcataacatcgacattactagaagaaacaaaagttgtcatgactttgttatatttttgagtactcagagggctaattttataacaaatgtaacaaatgataataataatataattcttacacatgcatgttgccactaatctaccgaaatattagagtagacaagaaattaacgtgtaataatttgtaagaactccgattgtcatatttgatttaatccatacaaaaaggtgaaaatccaaactaaatcttaccgtagaaaataaaacttaggtcgcgagtgtgagcttagctataaacacgcaaaatatataaaagaataattgatcttttacatgatagatattcataaatttttaaggcatttgcaaaccaattaaatactaaaataaatagcaaactaaactcatttgtcatcttaaaacctaacatatatattttaaaattcactaaccagataatatctattatacaaattttaataattgttaatttatattggcgaaaatcatgatatataactattatcagacactttagaattggatcaaccaagaagaataaaaaagttttaatcacaaccaaaaagtctatttgtcgttttcacttttcaccattcatcaaacaccaccacaaaggttttaaattttttcttttatcgtcttcacgaaaggcccattagtatataggtccattatctaaaaccctaaatctcttgttacgcattcccatgccttgttcaataaaaaattattctcaggcccattagagagttacgacttcaacctaaaaccctaaatctcttgttacgcatccccttgccttcttaaaacaaatttcttctcaggccaaaactcgcctctggaagctccg

SEQ ID NO: 5357 - DNA, 2000 bp, Arabidopsis thaliana
aatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagtatggtttggtactcaagctgtagaattttgtttctgggtctgcttattttgttggcttcgagctgggttttggatagatgcgagggatttggtgaatttgggtttgaatttcatcatcgtttctccgatcaggttgttggggttttgcctggagatggtttacctaatcgagattcttctaagtattatagagtg

SEQ ID NO: 5358 - DNA, 749 bp, Arabidopsis thaliana
cttaacaagaaaatacttggtttcacaaaattacctaaacaacaactaaacttttcaccgctgttccggtatacaactgtaacgatcgagctttgcctctccgctgtattcttcagagagccaactcgaggctggctcactctcagggtcagacctaagcgatggtagaattatggagaaatcaagtggaaatctcttcgttccttggtaacaagagatacaaacacttaactaacttggttacatacaacaaaaagacattactttgtacacttacttcagattttgacaagaaagatagaaactcacgtcattgtacagtgtgtttaggtctcaatattgtattgttttgttgaaagataggtctcatattgttttatttaaaacaaaatttctgaatttgcgtttacatgagagaaaattatagatttttttttcaaattaactctagtaaaataatgaacacaaattaaatgttatcaaatatgaagagtatcttgacaataccatttactttacgatttatgacagaccaatatatgggcttcattggggcttcattggggcttcattgaatttcaaagtctgttaaggcccaaactgagagcgcggttgcacaaattgtcgaaatttctcgaaaccgctttaatctcgatataaagctcgtctgctaaaaaccttcgattagggttttagtctgtagaaacaaagttgccgcttcgattccaaggagtaacctagctgagaaa

SEQ ID NO: 5359 - DNA, 2000 bp, Arabidopsis thaliana
ttgttctcagcagattaatactgctgggcgttacggttggattgaccatcttctgccatttttataactttacgcttaagtagcttatttgtagatccacattcgtgaatcggagtgtagagatttttttgacgcatgctttcaaaacaaattgttatttcctcatattttaagatcggcatattaaaatgtagatttatctttttcatttttatgatagccaaaatgtatggtaagtttagaggatagtttaaaactgatataatatgattagctataaagtttgaaatgataagttgataagttcgattttttaaagtataggtcttcatattgttgtgttgttctttttttgtatagttggtaattaaaactcataattcttgatgttaatgtatcaaatatgaacttaccattccaagcttttcttcttatgttttgcttcttgtttcgtcttatattttgctcatttttttgccttttttcttatattttaaattttacaacgattccaatttgtctaatgtattaatcgatagtgttgtagtaaaatgtattttatttattaaattcattataaaaaataatttaagattttttaaaaatatttcacatggtaatttcgataagaaacttggttggacctatgtaaatacataagaaggaaggcaaccacatggatgaagaaggacagcgggatggaactaagtcgtgctagcgatatacacggtgtttgttgacaagtatactggtgttctcccctcttaagatcgccaacaccaacgacaaggcactgcttcacccattccaccacggatcgtttcttagccaattgaccaaaaacgagcatgactgtggtaatgacacactgatgatggtatgcttatgtttgtgagccgggattttcatactattacttcgcgctagaggttttctcatcgggaaaattggatggcctatccctctcttgttttaacatgctttgcaattgaacatgtaatattggacatttcttgctctgttatagggcctatatatacatccccttggatcaatctccagaaaacgaaaattacttgaacatgagctttgcttatttaactacccggcaacatagcttaaaagtgaggtatttaggtcatttttatgtggatctacgcgtatcgcttgattttctttaaactttgtttgatcaaacgaatggaccaatttatcctatgatattatcttccatgtgttggtgttttgtaagccagttgaattcttaccaacatcttgtaccaaggagtcacttatttctgagtgtctttgtaagactttcttgttcatatattaaaaagatctacgtcgcttccaagctactataaataatgaaatcaaagagattaagatatcatgctatttcagattattctacaaaccaaaaaagagatatcgatctttctcttttatgctagttgctcaccttttggaagacttgacaactgatgaacaactcttactcataggattgaaagatctaaggaatgatgatatatacacgtttttgtgacagacatgcgtccaagttttgttcccatttggtcgtgcgtgcaggtttctctttctttgaccgcttctaattccatagatcgtgctataatgtagttttgagttatcaacatattaaactctatactttatatgatttaacgttgacggctgactattttattctttaacatcatagaacctctaggaacgtgcgtccaagtttgaggaattcagtgacgatggttttatctccccgcaaaggtcagctctttttgtcttctctacgttatttcatcaacgtgtaaacatgtcactaattgaaaatttccgtaaaaaaaaagaaggccaaattggagagagagaaagagatacgactttggaatttctaaactgttttataaagatggagcacatagagatattagatgttcataattagtaaaattgggtttcttgacccataagca

SEQ ID NO: 5360 - DNA, 2000 bp, Arabidopsis thaliana
ttctatttaaaacctggtgaaattgataatgtgttttaacattaatacatatactgataaaccattttagatgaagataatatctatataaaattttcctttgcattatctttgatacgtaaaccagatatattgcaattaaaaatataaaattacggaataacattgtagcgagaaattgtggagcgtcataataaaaaaagttacatagttttggtagaaatttttgacatgtaagttgtgaacagacccgttaacaaatttatgtctcatttactttatgcacacatactactcgtaacactctcacatcgtacaaagatatagatctagcacacgtataatagcttcggaagtcatgctgatgaaatgatgttgatgatgatgaatatgatggtgtatgattatatcatgatgggtttgatatcatcgattataataaagttatgatgatgtaaaaaagttaatgaattgaatccgagtgtcgtggtggaaacattaagtagcccccataattcatcagtccattcaactcatttatttcatcaacttattaaaataatataaaatgatagtcaattcattggttgagttaagtcaatgatctactaattttgatcgactttgatactcctacatttacatcaatgtttctttttctttctgaaatattctttatttaccttccctttgcatatatgtatgttctcaatttcaattcatattcactcctcctatttttttggcaccatacatcatgcacatctggatcgatacgtaacatgaaagtctttaagatttgtcttgtcaccattaaccagcatacgtgtttacatgtggaattaacattgctaatttactgataattcaaattgtacattataaagaaacttcattttttctctggtggcccgtggccacaaccctacattctaacatccattaaagagggttcgaacttaacctaatctagagatgacattttgagtattgtcgcaaataaaacattctgatcataattaacatttagttatatgttagtatggattcaaacctgaggttgatatgatcggatccaaacagtacactacattaagtttacggatcgcaatcaagattgttacgttggcatcaaggtatatataaaatatcttgaaattttttagtaatttttataatgttgtgtacatatgtacacatgcacaactataagctaaataaagtatgtccgtattacccgcttggtagttgaagacttaaagaggccatcatcaattccatctagtgacatttttcaatttctcataaatgatatagtttattctatagtttgcatgacataattttgttttgtttatatgatacgaacaaatttgggtgtaacaacatatgaccggtgactttatatccgaaattcagaattcgatatgagatgttctaaatgaatacttatgtgaaatacaaacaacgcataaaatgacgtatatatacttatgtgattataaatgaatatttggaaagtagaataaaaatttaaaaacaaaaagtagattgcaagtatgcaacatttgaatcctaggcgcggatggttatgcatgtacgacatgcacgaatgatataggctctctgcacaacacacaagatcaaaacaaacaaattctgcatgtagcattctaaaattttcgataaattttatatttgttgatctaagaaaaaattgtaatccctgaaaattgaatttgagacctggtatagaatctccacaaacataggaatttattattattaaaaaagctttattaacaatatatcatcttcttctttttttcaattaataaactggtaatattaaaatcgtcaaagaagtctctctctcccccatgtttgccaataaataggagataatcgctaccaaacttctcattctcacaagtcataaacagtcgtttatagttcaatccttttcctcttctttgtttctaaaaagagaaaagtcactt

SEQ ID NO: 5361 - DNA, 480 bp, Arabidopsis thaliana
attttcttttttcctagtgatctgctttggttttaaaactttaatgttttgtaagtgtagacgtgtagtctcttgtcattcttgctacactcttaagacttcctaactaaaaaatcctataaaagttgccttcttataaaggtcttttgtttgtaatggcttgttaacatgagtatttcgattttcactaaaaaaacaaaaaaagtattaagttggattatacgtgtttgaagatttaacaaaacttttttctgatataaaacaacacgtttcaaagcaaagggagcaactacatgccgttttgtatatttgttgacattttgggccactcgcatctgtacccttaagccctaaattgtgtttcctacaaaaccttttaaaccctaaaataaccgacggcgggaatttggtagttgcagagccttacagttaaaggcatacgcttcaccgttctcttccgtcttttctccactcgttggc

SEQ ID NO: 5362 - DNA, 2000 bp, Arabidopsis thaliana
atcatgaaaagttgttgaatgttgaacgaggatggtctaagagtttctttcttcttatgtatcatttcctaagggtttgccccaaaaaagtatcattttgtgtttgggttttgagttttgacaatcaaacatttatacatcacatgatcagttacagactgtatttagatttatgtacgacagggatcggacacttagtttttctgtcctactatatatctaagtttggattttacaaaattcttagcgtgaacatacttaagtttgatcttattagaagataagattgtattcgattctttgtgtgaacataagctctgatgtgtgatccaaatatgaccaaataaatctcgataaatagtttgtgtatatatttgagcttaagctaacgaaaaataatcaaacattcaattcgattcaccttattttaggatatttaagcaatctgtttttttttttctctctaagtcgtctcggtttgggattcgttctattgaaatctttcttaacaaagtacaatgacgtacacaatgcaaattcttggagatgtgtattaatttagtaacaccgacagttaactttatatttcgaagtacaaaagaatgatatgaatattttaccatttgaccaaagttcaaaaatgaatagaaataaacttaagctagaaagagatccccccatcccacgtccacgccacaccacaccacacagtttgtaaacgtggtcggcgactcattagcattcaatgcgtttaactgtttttattaagataatctttccattttcaacattcagtcaccatttttaatttttatttttgtagtatgtccttaccaaaaagagattttgctcaaaagaccatccataccaaagattgcaaacatgtatggtcatgttggttttaatttaatttggaattagtttaggaggtgcatagagtgattagttataagctgtccaatattaattggatcttaaattcttaacaattatgaactacattcatttaatttaacaattattttgggccaacaaaatgattattttccataaatttaatatttgtaggacagtttttctttctttcttgttttggtatcaagactcgagataatctaatttgtaggtacgtggacccttttaatttcgttctcgtagacaaccgagagaagataatacaaaacaaaaactcgacttggtcctataacacatcaattaatgattcaatatatgtgtactagtcgtatgatttctctatcattagttttagtttcctaaacgtaagttcttgtcatatcaaaaaccctttaacaaaaaaaaagttcttgtcatatcaaacaacaaatacaagttcttgactttcaaccatttaatgaaacatcccaacttgtacatataatagtaatcaattcgaaataaaagtaagaataacctttacaggagaataatacgcaatattaaacggatctccatcacatatattttattgtttggttatgactgttaaagtacatatatgtaatgacggtttcagtttcgctttgttaaaaaattatgattaacaagtggaacaagacttgtaatcacgtacttgattagttatgtgtgttaatctccgattatacactaactttgactcgtgttattttatttaacaccacaaataattctacttaaatattaaacaaaagctttgactcatactctctttcgactaaaatttttggtctacgagtcatacacgcgtatacttttcaaatatactattacatgttcacttggtaatctcatttaatgcataatcatgcaagctgtacgttaacgatcaatggcaatttcttgtaaatttgcaacacgctcatgggtaatttcgtcttggttttgttatataaataccccatcaattgctctccaacatgcattgtctgaaaccaaacaaagaaaatacacgaaggaaggaaaagaaaagtaaaaagaaaagctttctgcaaaatccaaac

SEQ ID NO: 5363 - DNA, 2000 bp, Arabidopsis thaliana
ttaaaacccttgtaaatctatttgccgccaaaaaatatttacaaagatttttaaaatcatttttttagctgaggaaaattgttacgaaaaagtttttggcaggaattgttttttttggcgggaaaaaagtttggcggaaattttttttttggcggaaaataaaaattttggcgccaaaaaattggcgggaaaagttcagtttccaattacatgtttctattagatgagggtaatttggtcattttgttcaagggaaagggtacttttaaaaatggaaaacataaaagggtattgttgcaaaaaaatagtaaaaaatgggtagttttgcaaatctccaatcatatatatactaagcttcaaactagtttagttttgatttgttttccgatcctaaacttgaattaagctcatgatgttgggagcctatataaattattagaacgtgatattcatgcatggtgtattcaaagaattacacatatataagagagactaggataaaactaattacgtttagataatactaaatactgaggtatgtcaaggatgctctaacatatttgttaggtggatccaaatccactatggtcgaagcggtgggtaaccgacgccaaatattatatactgtgcagttgtacaaaatggatgaacgctatattcagacaaataagtactataacaaaacaagaaagaactctttaagtacttcaattttgagcaaaggaaaatttcgagaataatggtttgtagtagcccggaggggaaacattaccattttggtctaaacacttcacaataaacttgaaaacaaaatagctagactagctagagatatatatgtttagtttcataatatgcatgtgacctcataattaaaccttattttgaaactataacttataaacagatgaactggtctttcgatctttaacaaaaataaaaatgaactggtctttcttttaacaaatttctgaatcttgtgggaactctattggataattggattcgtaagcacaaattgatccacgaccactacattatacatatgcagatatgttaatgctataagaccatctcttttattgtatgacttttggagataacagaaaagggaatcttttacagataagagtttagagtaaagagaaaagaagcctatttggttgattttgattcactgattaaaacaacacttgtcttttttatctttgccttcacgagaatcataactacactcaccgtcctcgccgatcaaaagtcctcgtgtgataagaaattcatgtggacaattttattgcaggtacgtatttttcatcaacttatccataacgacacgtgttgaccttcttacgtagctcttctgtatttgatcgccttggatttgctctaagacctaatttaatcacgccacatgcaacaattaactaccaagggtcccaaaaaaagaaagaaacacatactactctatttaatttgataataaacaaataaagtccgtttagtagattatgttttacatataaaaacaattaaagtccgttttgttaattatgttttacctataaaaaaaaaattcaccaaaaaacattaatcaaatcatatcctagttgatcattggtgaggtgactgacaggtcgtggaattctggcatcctatcgtcgacaaatcttaaactaaagtaactcttactgttactttttaaatatgtcaaagtaaccaatatcttctacggaacttatatccaatttgcatacttttactcatactatacaaaatacaagcggatataaacaacaaaataagaaaactacactaatatctatagaaacttcaaattgaattgaatattatcgtgatatatatatatatatatatatcgccgaatattccctggaaaattaaatacaaagactatactactctattggctataaatacacacacaaacccaacaaagctatttcattattcaaaaaccaatcacaaataacaaaacgaaa

SEQ ID NO: 5364 - DNA, 2000 bp, Arabidopsis thaliana
tttatcataagatggtcatttagctaagaaggtttgtgattcaaatcaccgtatatttcaaggaaaaagcacttgcacttgtatttaagaatcgtttcttctgctcttgtatctttttcacactttctgtttgcaaaaatataactaactttattgaactattatacagaactattttataagtaactgtaatatattgcttagtagcagaaaagtaaatacagaggtattgaactaattgtgttactcttcctacataaattaaaaagagagaaaatcaacaatataaaattgtatggatacgatttcatggaataaaattctttagattgtggaaaaacttatattagaatctttatagatcgagctaggaataaagaaatatgtgggtagcagaactcatgcaacctttaagaaagtcatgtgtaatattatcgataaattatgattaaaaaatgaataaattcaaaggcaaaatctaaattaaaaacgattttctacacatgtttaaatatctaaacgtgattagtttactttatgaattaccagtacaataaatatttgagaattcttttaagtcttaaactacacaattccaaaattccaaatacagtaaaagtaagggaaagaaagtcttaggaagggtacttacaaatttaagaagtattccttaatgttttcagttttctaaaaaacttgttgtatttctttgataacgccttcatatatatatatatataatatatatatatgcatattttgatcccaacatatatatatttaatgttttataaagcatactttgatgcaacatttctacaagttttttttagttcttataaaacagtggtgtttcaattttattagaaatcagaccaaaaaatggtttcaaattaatatttgcaaatcgagatcttaaaccccaacaatatgttctaaaatttaagatattcgagcatcaccgaactgtatttttgaatcagcattcctagttccttgagaatgagaattataagaggatgatgtgaaagtttatgggcaaaaagttaaagatgatgttcgtggctacgacgtgcatttcttgtcccccagtatcgaataaattgttaatttcaaactcattttcgacaatgattcctataagtactgaaatggaataagaaggaccttgaggaagaatttgatgacagcttctttttaacacaaatcaatattcttacacacggacacaccaaacaacattacaaatttacaatgacatgcatggtcattttgcaaatttttttctcgttttattctaatctaatttcgttctgtaaagttttatgtaaatgtaaattaaagatttcagtaaagacataagagtatcaccatcaattaggaaaaaaataaaaatgagttctcattagaaactctcctgccatgtgacatttttatttttatagtaattaatagcattaatattatataggtattagatccttgaagtggatggtgcatatattatttaaacaaaacaaattttaactacttttaatttatagcgttgacaataactaattaatctaaactaataaatcaagtacctaggctaccattttttaattagaaaatcgatccgccgcggattgttatccacccacaaaaataaaaaattcgtttgcaaatgtgataggcaagctagttccttgcaaccagctatatttttatgtagtggagaatatttaacaactaactggaattttaaaaacacaaagcgaaactaaattggtataagctatatattcttgaaaaaataaaaaaatcaacggctagaactaaagaaggatagcaaattgaatcatattcctttgcatttacttatttatttataaccaacaaattaagttctccgattaaaagctatataatgctcctccttgtctctcttctttgcatatcagtatatcactagcaaataagtgaacaccatttcttcatacatacacattccgaagata

SEQ ID NO: 5365 - DNA, 2000 bp, Arabidopsis thaliana
ggttgtctcaaataaagaagctgaaagaattgaaacaatattcaactagtcttttatcatttgagatgaaaaagttgaaaaacattattcaacttaaaaattgaaaaaatagcaagttataaagaaaagttgttcaacttgttcactacaatttgaatgatattgaatgatattcaatcctaaatgatttttattccattcaattttaggcaaccattcgtacccatacagaaagcaacatatatgatactgattgacaaaaccacttcgaaatggttgctccacacaaacaagaatatgagaagggcctacacaacgatattaattactgttaatttttgtttttgtctgcctgcatttagaatatggacaatatctcttcccggaatttgccatacaatcacaacaattaaagcagcgtaccataccatctaaataacagcattaatggctaccaatctcttattttttaggttagagtttagatctactttttaaaacctgattagcttgttccctctacaactataattaggggtggacgaaattttcgtcagggaaataaaaccaaattgaatcaaacagaaataaaacctatatacgttttaaaaattggtttaattatttgatcgcttgtctgtttgttctctgaagtttagtttatacaaccaacattgatatgtgtattttaagggatgatcattttcagttctgtttggttaatccggttttagtaaagctgttattaccaaactcttacaaaagtaattccgtttttttttttgttttttttttattctcggtttaaaattcgtgagcaagttatacataggttgatgacacaaaacatgatatggtgctgatggaactaaagtttccatgctagttagatcagcaaaacgcatcaaccataaactataaatggccaagattatgtcacaaacatccaggtacataattcagaataaactttttattacaaattttacgtcctaacaagtaacaagtaacagagagctcaaaaaaaaaatatgcatacagttatcgacatggctattttgtatcacttttaaggatttcacgtaaacaacgtccaggtacatgattcagaattctacactaccctttgtttgaggaagcgacacatgcttaatgcttttggccttttgccaagtgtatcaagaatggtataaactacaagttgacaatatattttaggcgaatgatttcaatggtggtagtactgggacgatacacttgtaacatttcaaacaatgcagtgacaacacaacagaacacaacacaacacaacatattttcctttgatcttgagaccatgcatcaattgcagctatcatcttttccacatactcagatctagacaaccaagataagtaatctctatttaaataaacaagcataatgtagaaaaagttatccagaaacaacaactctagtcacatataaaatttggcatggcctctgtagaagatagcaagaatgcttcatttcactattgcatcaaggacacaaaagttagtttaaaaaaaaaaaaggagaagataatgtcaaacatatacgtgtgcagatagacaccatgcttcatgtcattattgcatttttcttccctcacagcccatcaccaaagaccaagaacacacacaaaaaacttgttttaatgcgattttaatgtatttctctttacacaatcttactattttttttttatataaaacagaacaaattagtaagtttattatttgtgagggtgtttgattttaattacataccatattaataatttttgcttgggcctggaccacccaagtgtaaaggattatgaacaaaatcaagagcattaaaagcaacgtccctaccttatccgtgtttggtgatattatcaaatttttgcaaaagcaacgtacccatcttatcattattttataaagatcctatgtctatccgtaaatggactaatctttagacacacagagaatata

SEQ ID NO: 5366 - DNA, 2000 bp, Arabidopsis thaliana
gtattcggtaaacaagcttcgctgacgatgggtgagatccaaatcaaaaaatgtggtactgaatcgggagtgaaatgggcctacaggagaagtatccggcgtaagcagagggaacccggaaaagtattcggtgaactgttgagagatgaaacgggaaaaggcaaaaggttggcaaagggagagacaaatgtatcccaagacgatgaaggcagatgatgagcgttgcacaatattaaggcagaccaaaataatatgcgtacaacccaataatcttaacgagcctttacgaaatctagaagttcccaagatgggacaagcccaatttaaagtcttcttccaaaaatgtgaagtgaggatttgacctaatccaagcgaggccaagaacaagaggcggcgacagttgacggaggtgacaaggtcatcgaccacaaagattaagagagggcaaagatcactagaaagaggagacgaggagacaacaaccatcagcttcacacataagagtcgattctcgtggctggggaaggagaggagaacagattcaacaacgaagtagccgctggttcttccaataggaggtggagcatgtcgggccggtgggccaaagatcttcagaaaagagatgccaccagatctgcactcgacgagatgcaacaacgagatggaaaatgatgagaggcggaaagacgggatacaaacttgaaaatttcgggacaaaacgcgtttggattcttcgggagatgagcagagaatcaaaaagaagacaacgtccgacgccgacgagccatagctacaccagcgtcgaaagacagaagtttttgaagtgtttcgagaatagcgtctgggagagtttcaacttttatggttaatggtctttttttttattatacctcttttataaggttttttaaagatttcttttttaataagtttttttttggttttaaaaggttttaaaagttaccataaagatgactaggggtccaaacctccataagcccgcatatacatcaaggagcatttttgaaaaagatatttttataaatattttatggtaaaagacgtttttgaaaaaagtaccgtgaaaaggcatttctcaaaatattacaaacttataatcattaaataatttcttttagtattttagtaaattttattcattgacttttaataaatccatgccaccacatcaatgtgtttgctttttttgatcgattgataaagaagactcggaaaaaactctttttttttggattttccatttgcataatttttagattatccaattaatatacaaattatctgccatttggaattatacttatattaataactatcgtccaattttaaatttcatttgctctacaaacttgaaaaaaaaaacttgaatatataaccctaaaagtagagttcaaatgtgagcatccacattagttatttttttcagtgtctattgatgattatttttaaatatcaaagaataaaaaagcaaaagaaagaaatatagatgtctttaaaatgaaaattatgtttttctagaactatttgagacatctatttttgaaatgtctttacttttaatattattttatgtgaaaacatctgaaaagttgttagaatgagaatggtctaatattttcaactgcacgcttatgtaattgaaacgtcaccacagcgccaaatgctctataaataattaaatatgaaatcgtcacaacacaaagccacaacacaaagccacaaaacaatctctatcttatccatctaattttctttggtcatcactatcttatccatctctccctctctaattcatcaggacagagcataagaattgaaggtaatcctacggatctcggcttctatgatgttgcaatattgtagaagaaactctttaaattctcgaatactttaattttaactatatgtgttcttaaactaagaatcaaagtaagtgatcaaattcaaaattgtactcttttttttctgtgtaggtagca

SEQ ID NO: 5367 - DNA, 1254 bp, Arabidopsis thaliana
tttgttattcaggttagttccacagttttctggtcatagttttcggatttagattctgtacatggttgtagtttttgtgttacgaacttggctttactagattctgctatgtgcattgaccaactcgctttcatctattgtttgagtaatttgttcatcaatctgctatttttctgtttcgtctgttttctttttgcatgagctatgtattaggttttactcttgagcattgatttacttatctaggtattagaatacaggtatgctcatggtatatatatacctagtattgtgaaatgattgattgataagttagtgaacaatgttgatcagcaaattgttagaaatctgtataattggatggtgatttgatgtgtgctttggatggtgatttgatatgtgtgcatcactgctatatgaaaactgctttcttgaatcatgtctcataaaaatctcacatgatgttcctttaaaatagctgataatagattttgtattttgaaatccagaaaatgacacataatttctcttctttgcaggctatgctgattctggagagtgtgacttgtcttccaaaaagcctccgtaccgtttgggtctctgcaatcttagctctctgagaatatatattaaggtgtaatcgtttttttctggtcttttactattccaattactctttttatgtcgtgcatcgatttttaatcctatgtatggcttgtttctagttttgtttggaccaaactcgacagaggagccaatgtcaaaactacaatttgagtttgtgactttgaaagctgagattacttgaaagaattttaaatgcagcagtgttcattttgtaacatctgagttgtgtgatactggcttattgagtcaccgatagtttttccttaaaactaaaatgtactattgcaagtaaaaaccaaacaaaaaaaattcattcaaacttgcattataaccaagtaaacgtgatcaatagaaacttgcaaaatcacaaccaaaatatttgtccaaacaatatgtagtcaaaacagtctgttgtgttcataaaaaagtcatataacgatacaccaaaaagaaagaaacggaggtgtttggttggtagtatattcctcctcctcctctttcttcttctccctcctcactatatattttgaagtttattaacaagaaccaaaaaaagtcacactcgaagtctcacaccacaccaaccacttcttcttcttcttcttcttctacataaaacctaacgcc

SEQ ID NO: 5368 - DNA, 2000 bp, Arabidopsis thaliana
ttggacatttggtagctatagcaactatttactcgtggaaataatttatttatttctgtatgaaattatgataacatatctgtttaaaagttgtattgatgcgacagcttttctttgatttaatgctaccttatacttgttcaaactggctgaaaaatacatacaaaattattaaattccaaccacttatcacactatcctttatgtgataataagtttagctgggcaatgttattcattaaaaattggtgatgcaacacaagtcgaattgacaaagatataataatgagttaataggctttatgatttagcgggacatggacatatattcaattttgtaaatcataacaaaaatgatgggctatgagataaattccactttcacttttcttcactcaaacaaatgctaaaaactaatctatcgatgaatgattatatgcctttttatcgtcgccactatgacctaaaatatttcaagaagtcaattttttaatttgtatagagcaaaatgttttgcaaataaaagaaaaacattgttatgaaagaaaataatacagtagaaactctataaattaatattcgataaattaataaacacgataaattaataaattttgtcggtctcaagtcgggtcaatgtaaaaattaaccaaaatcgataagataataagataataatctttttgaaatccctatgtaaaaatatgatcctaataatatcataaattaataatcataaatcttaagcatacattctaatactaattttatctaaaacttttattcaagccacaattacaactctttttagagtacagttggtatgatctcttttgtactcacataactccttacgtatttgatccgtcatatttggttttgtaacattttttaatcattgctaagatttgtgttaaaaaaaattggattaagcctcacgttaacgtcgtaaatatacggacacaatattttgtaaaaaaataaattaaaaagtcaagagaaaaataatttttaacataattgaatatacgaacaacaaaatataagaaaaattaaattaaaaaacatatttaaaagaatttaatattgtattttacgtaaaaaaatttataaatatttattaatttataggataaactaatatcactataaattaataaaattttatggtaccaatattattaatttatagaattttttatgtaatagcaaattaccattccaaaatttaatgttaatggtaaaaaaaaaaaaaaagagcgaaagaattttattttattatagctaagaaaattggggagaaaaatcattgcggaagcattacgtttgcatttcatcacatattcacacgtgcgctcaagacatttcacacgcacaaatataattgacccacaatcacaaaaaagctggtcatcactaatttttttcaacaatttccctacccctctccaataattgaaaattttatatatattcttttggcaaccatatttaataaacatatatatatatatatattggtttcaattatggatattatataatagcattattatgtataattcccaattttatgtaagttatgaatatattttacacagcttgttaaatgctttactttaaatctacatgaaaatcaaaatgtattaatatgtccacaatttaaatggttgatttcatattaacatgagaaatcacaaaataataagtataaaaatgaattacgtaaatgatgattttttagtttaaataatcggtcaccaaaatattcatattcgaacatggtcgccacaagcgacattctacaaaaaaaacacatacaagtaaatagaaaatagaatttctcctctcaatgattcacacaaactctctatataaagccattacttaataccacacaaattacaaaaaaaaaaagaaaaaaggagataataatcacaaactacaaaagtagaaagaagaaaaaagaacaaagtatcagttcttgaatatttgcatca

SEQ ID NO: 5369 - DNA, 1127 bp, Arabidopsis thaliana
tatgtttctatcagttgattaagaaatgaagagagaaaaaattctgaatttttattttttattaattaaatcagatagctagaatgttgatcatgtaatatggattcaaacattttctaaatcaatccagattgaacttttttctttaatcaactttatggtggtgtatatagttaattaaaaacattttctatatttctatataccaaagtaatttggttaagctctaatgtgtttgtcacttcgtagtttgtacacgtgctgatataattatatattggtcacctgcaatgagcttataaatagttttctaatttgtggttgaaattgaaatgatctagaaatcttctcactaacattatatgattcttttgtagaaaataacactttagtcatcagcaatttgaatatttgctaagtttctattatcatcaaaaggggaactagtcctgtgatatgataaatttatactattataatttataccaaaagatatctgtatcagaaaataaccaaaattgggtaatattaaatgttaaatttgaatttcggctacaatagaggaaccgttgagctaaagttgatgaactaaattagaacaggtattccgctgaattcatggcgatcagtcaaaatcattatcatattaggatggacaaagactaattttcaaactcatcttttgaatttaatttatccattttgtgtttaacgacactatattatacgtttcatcaagacaaagtattttaaaatatcagaaaaaaattccatgcagatgactgacttaatgaggtttgttaaactgtcactgtcagttaaaccccctaactcaagaaatgtgtactcgcttaagtaaaatttgagaaatccttgttgtaaaattctggcattcacctgtgaatgtgattagattttaatcatcaaataacttattcattaacaaaaaattaaaatataagcacatttatactatagagactagatccagtggctatagataaatgaggtggcatatcggagggtcaaaacagattggtgtggtcctatttattcaagaaaggactgtatcgacagaagaagggtttaaagaagacaaagaaattaaaggagaaaaatcgatcacg

SEQ ID NO: 5370 - DNA, 2000 bp, Arabidopsis thaliana
attttatttgatgaaagtaattttttcgtaaaaaatactagcgaacacagtttctcagtggatcataaatttcaagaacaaaatagtgaaatacatatgatcttaattgtacttcacttaaatattttacgactttcaaacatgtgatatacatacaataattaaacaataattaaattctgcataagatatttgaagccaactgttgaagtggattaagagatatgaaataataaaggctatagcacatgcattgttgtaactacacaattacgcaaaagttctatcatcgaaatttgaatcttagtaatatcttaattagcaaagagcataaattcttttgttctttttttttttatccaattttttttttcttacatttaacctttttttttttacatatttcacacaatttgagtgagagggataaatctattttaatgttaacatttatatgattttgagttcaaatttgaattgctaattatctaaccgtttttattaaatttattttcctggaaaaataaaaatcttgaccaaaaatctgtaaaaataatttaataatatttatgttggattacaaaaaaataaatatgattactatgcttatattaaaaatacataggaaaaagaggtaaggcacatatatttgaaaaacaaatcttagaaaaaattatattgttatatatatattcaagtatatatgaaaatcattttcacaaaatgtaagaaaataaccatatatcagtaacgaaaaaataaagatgggagttccatttgtttattttgtggaaattagaattgtttacttttgaaactttatcaacaaatctagaaaatgttttgtagccatcgaaatctttactattagaatttgaagtacaaaaatgatatatataaaaaagattgagacgtatgaattatcaatacacttaatcttaccatcatgtgtaccaattgaacctttaataaacatagttacctatgacaaaaatggattgaaatccttacttacttccaaacctacaaaaataacacactgtagtattagattaccattctttttctatactatgaatctatgatgcaactttttacttctccattgtagaatcttcttgaccccaaatgtgtacatcatcccacttctgaaaatttaaaaattataccatataaaagattggaaaaactcattacatgctgagaattgtgagcacaaaatgaggtaaaaatttaagaatgttaattggtttgtgtgtggtgatatcttaatgtgtatataacaaaaatatatttactatttataatgaaacaaaatgtaatgtattaattttgtagttttctagaagttcatgtttggtcttcaaggtttgtgcatctcacttgtaaaaaaaaaccataaacataaattaggagtaattataaaattaatggcccacttcaatttatttctattaattgacctaataaattatgtgttgaccttcttctaatactaaacgtttccccacttggaaaaaataaatttcaattatacaaaacagtaataagtaagattaatgtatacatatatgagatttatactattaaaatttaacaaaataaaatgaaatgccaagtggaccaataaaaaatatatgattgggtgtatttgcacttatataaatcaatgtagatttctgaaatactttcaaaagttttggatttcttattaaatttccccattttataatttattctttcggatttgttcttttcttatctcttccattttgataactttcctcctctgaatttttaagacaaaatagatttcttcttctctttgtttgacccacattttctctggaaaaaattcgtctactttctccgatcgtctcttcattgatcggaaaaccaacaacgacccattattcctctcctgtttctggcgcaaacccttgtagcaagttttgattttggtgagaaaatattttagggatctgaagagaaagaacacg

SEQ ID NO: 5371 - DNA, 2000 bp, Arabidopsis thaliana
tatcgatctaaagtataagatgacaaaaaattcctcgtatcatttgggtttaaatatatgatgggatggtaaatggtaattaaagccaatagtaataatttataaaataataacgacaaaacgaaataaaggaagaaaatttgcaagaataactaacaaaaacttataaattaagaaagtaacacaaaacaaaaaaacagatatactctctatattatatataataatggtatatttacccatttttctccacctcattctaagtccctccttctctcttcacctctcatctctttttctttcttctctcaatcttttttttttttctttttttgtatcacataacaaacaaacgagaaggacaaaatagatttttcagataccacttatgttatctggttgcttgagttgccaaggttgtatcttagggtatagtttttctatacatccaaaatagtatagtacaacattttatttctatccaaaatagtacatgtttttacttacaaacactatttactattttataaattcaaatccgattttaaaaattcaaactattttgtatgtagaaaaaatataggttttttctaataaattttataattggaatttattttttggaaaagatatataacaaaaaaaaaacaaataggtgaaaaactaaactaaatgttactaaatcattttacctccaattcaacactaaaattgtcttttccttatccttacatgctattttcttaatttttatatatatggtactatatttttaatttgtttgtcaaatatggttattcagctaaatcacccaatagagactcaatagagactgagagagagaaaaagaagggtttctcgtaaaatctccaaattcatttgaactttcccaaacattggaatatgtgtaagtcccataggagtaggacagagtcgataggggtgtgatcctaacataccagagaaagatcgtcgaatcctccatttctttttatggcaaccatattttaattatatactactatttattaatttaattgggtgtgatttttacttcgcgtaatataaatatgctttttctacattttcccaataattttgtaaaagtgtaaagtctctacaaaaacattgtttagtcctccttttttggtctaaatatttgtttagtcctatatccatattttgtgacactactagtattataaaaacataacaaattctcaagttacacttctcgttttgtttgggtcaaccacacaacaccacaagttttacttgtacaaagtaattgtttgtttatgtttttctgttgtatgtattttttttaattggtcaaaagaaaatatgttttaaataaaaaggtgaaaaaaggcctatgggattggaataataagatagaaaacaaaatagcatgctttgcttcctccactaaacttcctttaagggcagagagagagataaaaagattgattgcgtgtgtttcacaccaataaatccctttatttttattttttggtctccaaatttactaacttctaataatttccaattttaccccttatttttcttcctttggttttaacctattcactgcatttccttggtataaaatccaacttcttctccttcaagaatctagagatagagagagagagagaacacaaagtgggaaaaaagataagaacccaccataaagttttaacatttttcccttcaaaaggcgaaagcttttgatttgtataaaagtcccacttaatcacctctctagcttctcattccatttccatctcctctcttttgttttctaagttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatccta

SEQ ID NO: 5372 - DNA, 2000 bp, Arabidopsis thaliana
ctataatagtcaggtcgtagtaactagtaatatctgtaaacttgaaacattattatgaaatacggtcgaagaaaattaaattaaaataggttactaaaaaaaggggggaaacaaaatcatggaagcatgcaaaaggagagctaagtttgcaagcaaattatacgagagtgggtcaccactcactcttgtacaccacacgtgcatgcttcttctttccttattttttgtttcgcaaaatcaaaaacaaatttagttttcgcaaagccgaggtaaacaaattcaaaaaggataaagcaaattatatataggaaaatcggtaaaaaaagaacaaaaagagaaattcaaatcttgactttgtttaacctttagcttttcttctttagtcatcgggatcaccgctgtttataaaaaagatccatgaggcatgcaggagttatactaatccgggcccttcactttgatctattccgattttctttgggtccactaacctttaaacatatggagtagtactataatcttatttatcaaattatatagtatatccgcctacatcaataattggtgctacgaatgtataaaaaacactaatcttaacgtaattaggaaagtagaaagaatattgtgtattacctagtagtaagtatgtgagaaaccgatttgtttgattgaataaaatttaacagtagacagtttgtgatatgcaacctgcaacgtatacatgttcgtggccccaaactgaactaaatattatcataaccttgctatatgtttccacgtatttcaatacaaaaatatacacaatcaacacacatgtatatgtcatagctttgtaaccagagttttacaagttttctgcgttctttggacaaattttcctttcgcttaattattaaaaactaaagtattacttcgttcacaagcaccaacagaaagaagaagaagaatattagacctgcggtgcaggctttttatcagatatttttcttcgcataataacattccaaaagacaaaaagaagatgtgaacacggtccattaaattcggccttttcgatataaatatgatactaatatatgttaattctccaccactttaaattatttattttcataaaaacgtcgaagattttagattcatacgtgcttctttcctgatcaaaagtagtgtcgatcacatttttcttttcgctttacaaatttactactgattattttgtctaataacaacgaaacattaatactacgaaatttcgacataaaaatgattcttgatcacgattcacggacaacggtctcaccgcccacacatgactcatggcttgagtctatatattgaaacaatttaggaaacaataaggacaagtctctttttttgtttaaagatgaacaaatttttgtgttcacattaataaaaactaaaaagaggattcccatgcacacgaaccaacaccaagagcctttttattgtattttaatttctttatttgagccaacaactatttattttcgttcttctttcacactagctctaaaaaccggtttaactaaaccagtcaaaaaccggacgtatgaaagcgttcactgtcttctctgacttacgcgttgaccaatgactacagtattttgaaaaaaccttcgtgtgatataaccggttactggaagtctgtaaccatccgtactgtatatttaacctgctattgccggtcaataaaaaaaaatcaaggaccaccatttaacacagtgcggtgacaaatatcaaatccttgagtcattattatctctttcctctcttacgccatacatttcatctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaaca

SEQ ID NO: 5373 - DNA, 2000 bp, Arabidopsis thaliana
taattgcggatctcatcaataggttaagtagtgacaacttgttgcgaggataatagtagtgatggttttcgaagatgagttatcccaaaaaaagaaaacaattgacgtggtgataataagtgatcaataatgtatgtaaacatatgaatggtgagaaacgtaaatgtttattttcctagtaatagataagatacttctagtttagagtggtccactactgtctctttaacaaaggcatgatgaaaaaaaagttcctacttgcaatttcatgtttgtttaattttagtatgactcaaaaattgaattattgaccaataatctatttgatggttcgttttacttttattattttttgttgaaagaacaaatttgagagaaaaaagcttagttaaaagttacttttgactgagcgttcgatgctttttcatctaaaccacttggaactcatcaaatagtatatttttgcttatatatacgttttcatatattgccaaacaaaattatattgttacgatgatattgtaagagcattataaggattaagttgagttaatatgtgtttagctatgtttggtttaatggaaaatcatgtgcaactagcaagaataatatcacacatcactgtttttgactaatggacaaattggatgtgacacttaatagaataattctttcttggtagttgctatgataactatatttgtcttaacgtgagaaaagaagcgattggattgatgaggggaaataagttggatatgatctctgaattcaacaaacacacatcttttacaatgagcagatgactaaactttaatacactaatatggaaagttcgaaggaaaattaccttggatgatgatgatattcgagtccagcaaacacgctttgctcaaaattgttaatccaaaagaacaaaagacatcatatctcccaatatttaatcatgactaaacaatagtaataaagctacataaatgtataatttatgattcagttaaataaagttttatgtattttatcaaagagagtccaaaagtcattttatatttacttgtcgaatatttattgtcacatatacatatgaaaacgacccagcagcttccaaaaatttatgacgttatatattaaaatttaatacgttattagatgacgtggcagtttatcattggctaaccagaaaaagctgcaagaaaggaaatgtgttactataaacttggcgcctgtcttgtagccgttgctttcctctccggccttttctctctcctctcttcgaccgtcgtcgccggagacccttttcaagcggccaaacaaagatgcaagcttttttctttaatactactgtagcactatcgcatccgatgctgttttagattttgggtactctgcttctctttctcttcatcttcctctgttcgtcgtcaggtgatccttaaatctctgagtctcttttcactgttttttattttgttagattctggttattatttgattgtgcgtttcacttatccgattcctaaggttttaaatttgtttccacttgacttgacttttgagtgtgctcctccgttttctaggtcgtgtaacccaatttcgttttttttttttttattggagattgttttaaggctttcgaaagtttaatcctctctgtttctaggaccagtaatttagctatggattgtcttgtcgaattgggtagttaaaatatctgttttttgcttttacatcgtcggctactttactggtttttgggggacttcgttggatctttcacctttctttatagaaagaaaacagcttttcgcgtttattgcgcgtacagtgatgtttgcttttctgtggatgaatccgaaattcgcttctctgtgaaagtaaatcttactgttctggatattatcttggatcctagtctctctctatcgcttatgtttgagttcacaagtctctcaaggttttaacaagtattttaatttggtagctgagtttgattgtcggaaaat

SEQ ID NO: 5374 - DNA, 2000 bp, Arabidopsis thaliana
ctttaaaatgtctttgaagtcgacctttagggagggttatgcagataaaacacttcccacctttagtgatatttgggttatttttctatatttaaatgtgattaaggagtccaatgaacttatcgttgtaggtatgagaaacgttatttacgggttcagacaaaagttatttaaatggagtaattttaaaaaaaactaaacattttgatccactaaggaagatgaaacattcatcaagtttgttaatgacctagtttagatcgactagctagatggctagccatgtggttgtctcgtcatcgaacatcaaatactaattaatttttctttttctcaaagtgtaactttatatatcattcaaaagatctatacactgcaatgccaaactcttgtttagccagacacatatctactcgattacatatatgtgatttgcattgtgaaactttttaataatctcaaaccacaaaaaagagcagttcaagcactacaaacgatactaatagtgcttcagcttgttgatctaattgaagtaagcactataattttaaatttaaatcctttatcaaaaattttttttaacaaaaataacaaaaattcgttcgatccaaatttagtttattacataatttaaatttagaacaaattaactgcatatagaaatataaaatatttcattctgttctagtgaatattttttgttttttgaattttttttcccacataaaaaaaatcatgtgttttttattgttaagcatgcaaaattgcaaactgccgagaaaatagctaaaaattgtagcaaattattttaatggatattatatatcattttgtgacggtgtacaagaggatattcatagcaaagtgattatgtttgagccccacaaaaaaaaacttattgaataacataactaacaaaagaaaagtttattgaatatttggaaaggtaatatatccatccatagaaattaaaattaatttataatctaatttgtggaccagataatccttttgaagcctaacttaactgccacatgttgctgccgtcagcacccgttttgcggaactgaaacaaacgaaatgtatattctatatttagttttacttgcagattttacacttgtaacaaaaaatgtgaattgagaatgtgtttttaagtaagtagttaagttaatttgtcttggtcttcttcactagatgatttgaataagttgtgttactttgtatagtagggatccaattaactatagatcggattttatagatctaaagatgttaagtaaaaaaaaaaaaaaaaaaaaaacttgcaacaaatttctattttctttcaaatttgcctttggtttgctttaacaagtcatttttgacaaacaaatacctatgtctaattaccgttccaaatttaatttgaatctgtccttttctctataattgttgtcacaactattaaaaaataattaataattattattactttcacaacttaatttttttttccacaactataaaaatggaaaattagtgaaataagtagttaaaaaataattaggtagatagtctttaaaaaaaaatgtcttcaatgaaataccgaccaaatacgttactccattgtcaaaatcatggccaagttagctaccgtcttgactagttattcatcatttaagagtgtaaaaaaatgtcaaatatttgagtggtgccttttactcgattgttcaaaatagaaacatattcattaactagggtggacaatattttctgtttgtatctaataaaaataaaatcgtcgtttgtttttttttgtcatcttacacagctcataaatgataacgaaatatgtggacaacagaaaatatcaatttatggctttctaaattattataataatttagcatgtggtgataccacgtccaaactgacatatctttgcactatatatatgttgttattcctctttcgattccctcataaaccatattaagaactagcttatagataaggat

SEQ ID NO: 5375 - DNA, 718 bp, Arabidopsis thaliana
ctacgaagactttcccaatcttttgtaatcttcaaaatgtggttactttcagctcaaacttaactttcttattactattttatgatatttgataatcgatcaggagaccttttttttttttcttaaagaaattttcggaactactagaattttctcttggaattgaaaatatattgttttctcagttgccgtgttatatatttaatatcaaaagcatgcagtagctaagctagctaggctttaccatacgttaatgatactgtctttttctctttacaattccatattcgaatttgatttgtatataacatattgggaagaatcatcaatatgtattcagctcaaaagaattcaacaaaaaaaaatgcctattatcaataaaaattcactgggctttagaaggcccacaatagtataatggatcctttttgttgggcttatttcagtcagggaacaatagccttgattttgttgggctaaccgctaacgcattaaaaaaatcacggtcaatcggtgatcgtcaaatctagttacgtggcatttaatatttaaaactacaaaatttaccagtcttggctcaaaaaaatatttattcacttttcttcttctctgaccaaaatcaaaatttgttcgattctcattcttcttctcacagtcgtaaaccctaaaaaaaaaacagagaaatcaaatttcaatctcgaaggatctacaaagaagc

SEQ ID NO: 5376 - DNA, 2000 bp, Arabidopsis thaliana
ggcctgtcacaattggatgccgcccaaaccgccaattatttagactattcattttcttttgaattttgagggttagtgacatcgaagatgattaaagacaaccaattggtataatgctatgaaaatgatggataaggtatttcataatatgtgaagataagagtgttctgttgtcatgttaatatcctgcatttaaactaatgttgtctcacaccaattatgatagatggtcgtattcttttatatctatatatattttttttggttacaatttgtattttttagtttgggaggtgctaaacgcctaaaatattaatagggattaggagttaattcatgtaccaccgctgctttgtttggagttggtgtgtaagagatattggcatatacatgtaataaaattgcaacaaacagaaaacttaagatcttagaaaagtgatccaaagtagtggtgacattaaataaaaatttgcagagaggatggttgtttataatactttctccgccccatgaattttaaaagtaatatttttagtatatggtttatggatagttttttattatcatgaatttaatttgcagtatagaacaacgaagtggaatgctcaatcctagattaaaccgatccctgacaaatgtttttccacccactaccgcttaaaagttgaaaattattccatcccagtaaactgatattatgaaccaaacgtccaaactcaaataatcgatctgaaaatgaactatattttttttaaaattatgaattcatttttcctattcaaaatattgaattcgaatccaaactaaacaaacagaaagaaaaacctgattttaaatccaattttgttttcaagttaaataaacatttgattaaaacttgaagtcgaaccaataccaatacgaaaccgtaccaaaccatctatggtacaaatactatcattcataaaccaaaataccaaaaaaacctaacagaaaaaaattataaagtgggcctaagcccatataaatatcccaatggattccttttgatctgatggtccaaaagtccaatccgtcaattgcctaacacacaaaagcctctatctattagttagtgagtgacatgtctcttctctaattttatccttaagacactttccattttgtttagccaaccaatcatcttcattacactaatcagtagtcaatagtcatttcaacaataaatcttctaacttttaccacagtcacgtcaaacaaaagttgttttcttttacctcttggtcatttaattttcttttaacggaactctagccagtaaattacactaaattttaacgtacgttaatttaaaagtaaaaaacctttcgcgtctttttgtttaagttcaatattagccacacgatccagaaaattcgacacgtgtcactatggattaagcggcatcagtatccatctttattttctctccaaatatttatttaattttgggctttacttaaaccagactcatttcatttgccgaggaaagcgaatataatttatcgggcatttctctcccaatctgcttcactcgccaaacctcgtttcttcgccggaaccctaggtcacctccgtcagtttgaattttccggtgagtttaacttcttcgctagcgtttcaatttatcattttaagaaagttcactcttttaggttttcgtgtgcccttgaattttgagaaggaagagattttataattgacgcgtatggttttgttgttggtggagcagtagtagatgaacgtgcgattaggtaacagttgaggtctgacggccaggttttcttgtcaccgaatggagggaggtagcgtctccatacactcttgtgtcggtacttttcgctttcctactgttttactccactcgacaagaaaatgaccagagtcgcttctttaaatatgtttcacggttgttgtgttatgcttttgtttcttttggttgtttgatgtttatatatgtctctgatttcaggaataaactc

SEQ ID NO: 5377 - DNA, 486 bp, Arabidopsis thaliana
aaattgtgaaatccatgaacacactctgtttacaattagtaccttttatgtaatggggaaaagagtaattttgtagaattctcagctataattgcaattacgactaaatgtgaggtctaatttgtaattaatatttttggcaaaggtcgggcctggctatgagatcaataagcccatgtagggtccaggttagtaagaaaagtcaacataatacttgtagcccacgaatatttttgattggtattcctatattaccccgtgtaatctatgttactttataaaaacaccataaggttataacagtcattttgagtttaatcaacctttattataaggccttaaaccctacgcgtaagcagcagccaaaacatttcttgttcatctctccgaccttaaaccctccgatccaaaaatctccaccgactctaatccaatcaaatggcctccgtcgcgcttctacggtcttttcgtcgccgtgaagtccaa

SEQ ID NO: 5378 - DNA, 2000 bp, Arabidopsis thaliana
ttgagaaaagtagacaaattaaaaagagttttatgtatatcttaattatcgattttattcgtaattgaaattgtatttgtttacggcaaacatggcatatgaagaattctgatacttcaattgaaatgacaaacacttgaagaaaaaaaagtcgagtttacgtacgtataagaacacgcataaatcgaatatttaagagatgaaaaaacgttttaatattctctaccaactatatatatattttttttcctcaatatataatttgtttttaaagttttattaaagatggactactttgctactctattctcctatattattttcaaaatattggatcaaaagatggaaaaaaaacgaaaaataagatgtatacatttttaaaacaaaacgtagctggtgctatgtttacgaagtatgtacgatactcttctgtctcttattctcagccgttcaatgtggacacagtggggtccttctctttctttgtactaagttcgtcacaagtgtcaagtggaaaacctactttaaattattaattaaaagttattattgaattgaaatgcatgcgacaccatttgattaccaatcaacaaatcagttaattatggttttggtgttgtgaaatatactcgagttcttttgggttccactttggatttaaatactgacgtatgattcccttgaacttgaccaaattaagtttatactctttgttacaacaaaacagatatatacctttaacaattacttttttactttttcagttaaccatttttatcgttttttaccgcatcgtcttctccatcgccattacacaaaaacctttggtagcacttaaaaacttttatcagactggccacgtcacgtattgtatattgtggttgtgatcaccatatttaaaaatggcgaaatctaattaaaatattgaatgaagataaaattagttattaatatttttaacgtaatgtaaacattaacataaattatacatagatttattttctacaacatatggatatatattactatacgattatgacactattacaaatccataaattggtatcatcttatcgcaaacttcgttgcacacaaacaatttgactaaacttttgatcgtgctacaaaaattctgtgcacaggaaaaaacttctcgtgaacaattatttcttaccaaaacaagcgacctaaagtttgcaatttctttccccccccaatttggcaagttgacaataagtgtttccctagactttctcgagtaaaattaaacttttatcagactggcctcgagtgattcacacgcgcatctcggtagcgcgtcacgtggcatgtctcgtcttattacagcgtatccaaattgtttatctgttaactgttacgtgtgggaactctatgatttagtttatccacattaatcagaccctcaaacatttacatttaccacctccttattttatttatttctaaatagaccccttcactattcagattcccagatatgagatcacagagattcttacttgatttgacgaaagacaaaagagatggtctaaattaaaaattcgtttgcgcttattagatggcagaatattaaacacattcacgaaattacgtactacctttcgtgcaaactttttccatccaaaagttggttttatatattaaatccaacggtggaaagaaactctatcaaacaaggaccactagatttcagaaattaaaattagggtttattagatattgataatatattatggggtgtttttgtaagaaattcataatgagtggtatagttgagattttatttgtcatttcacattcttttggactcttctgcttacaaaaatgctatatatagtcgtccatttcccttcgtttaaaacttatagcgaaatctctaattacttaatctctgaatgcttaagataataactataatctaagagtaattaattaaacgataagtggttaaatttgttgaggttaaaagtgaagcttca

SEQ ID NO: 5379 - DNA, 1647 bp, Arabidopsis thaliana
gtgtttctctgtattaggtcataatcaagtgagagcgattttgattaacttaattagatagagataatatgtaatgaatgtgtaagttcctagttttttggttccactaatgttttgtgttcattttcttgatgaattcaaatatcaacacttttttttggttcttagtcattcaatgccataataatgagaattggtcttaatttttagtgcctcaaatgtcattctctgtgtatgggcccatatggcccaagatattgggctttatcgggggaatcgtgaggcgcgtgattctagttgtcttgtctccgtcaactccaccatttttttgttttttggtccattgatgtcgtttttcatttgatttgaatttttatatgcttttgaattcacaactggtttcaaattcagattttgtatggtttagagttttttttatatatatatcatgctgaggttgtatacttcgatttgttttttcattttattgaaggatggcaatttttcgatttgcacttggcagagtatctgtttgtgtgattaaaagttgttatggtaactttgtaacagggacagtgtaaattttcgatttgcaattggttttgtttttcatgtaagcgtatgattcaaccttaataagccatcattaataattaataatggtggaccaacaaaattttaagtaatgttaaatatggcaaagtcatgaatcatacttataatttttttttaaaaatctaaagtggtgacgaaaatataattcatttaaatggatcactggtggacgaatggtgtgagtgtgacatggctaggtagagccgtgaacctcgagaatgattcaaattaacggggcaacttcgttcaacgggggactttcttttgaccaaagcttctatttatgtgtttcacccttatattatgcagtttcttcgatttaggaccattacttccattgattcctttattttcctaagcaaagagtacaatttaggaataacttgtcgatattttccataaacaccatttcttaattttggagatacgttttccttattatttttcacaaattcaaacaaaatcttcataatatattttagctatcaaatcacactctcaatacattcaaaacttccataaacactcttagaaatcactaaaatttagtagacagaaatatcagtaaatatttgaatataagtcatttaagcgaacattctataaactgtgtttggtatcaatgttttatagctaacgattaggtgtaaattacacattcacataattactaagatataggttggggttgcatttttttattaacagaaatatatggttcatcttgtaatttgaaaacttaaacccactattttataattttgtcagaagaacaaaaccttgtctttggcttttgttcgtaacctttgtttacttgatcaagaaaaaacattaaaatccgaccaaacaaggaaatatacacattttcaacgcggacataaattttcattacagcgtcttactaagctgttctgttctttaacgcggtctcttcctctcttcaaaattaaacttccgatttttcaccttttcatttccagaatttgttttttaaaaaagagatttttgtgagtgaagagatttagagtaatc
